United States Patent
Saffroy et al.

(10) Patent No.: US 10,385,401 B2
(45) Date of Patent: Aug. 20, 2019

(54) METHOD FOR DETECTING CHROMOSOMAL REARRANGEMENTS

(71) Applicant: Assistance Publique Hopitaux de Paris, Paris (FR)

(72) Inventors: Raphael Saffroy, Paris (FR); Antoinette Lemoine, Marne la Coquette (FR)

(73) Assignee: Assistance Publique Hopitaux de Paris, Paris (FR)

( * ) Notice: Subject to any disclaimer, the term of this patent is extended or adjusted under 35 U.S.C. 154(b) by 254 days.

(21) Appl. No.: 15/038,122

(22) PCT Filed: Nov. 21, 2014

(86) PCT No.: PCT/EP2014/075318
§ 371 (c)(1),
(2) Date: May 20, 2016

(87) PCT Pub. No.: WO2015/075196
PCT Pub. Date: May 28, 2015

(65) Prior Publication Data
US 2016/0319365 A1    Nov. 3, 2016

(30) Foreign Application Priority Data
Nov. 21, 2013  (EP) .................................... 13306589

(51) Int. Cl.
*C12Q 1/68* (2018.01)
*C07H 21/00* (2006.01)
*C12Q 1/6886* (2018.01)
*C12Q 1/686* (2018.01)

(52) U.S. Cl.
CPC ........... *C12Q 1/6886* (2013.01); *C12Q 1/686* (2013.01); *C12Q 2600/118* (2013.01); *C12Q 2600/156* (2013.01); *C12Q 2600/16* (2013.01)

(58) Field of Classification Search
CPC .................................. C12Q 1/68; C07H 21/00
See application file for complete search history.

(56) References Cited

U.S. PATENT DOCUMENTS

| | | | |
|---|---|---|---|
| 7,005,265 B1 * | 2/2006 | Fan ...................... | C12Q 1/6844 435/287.2 |
| 7,198,893 B1 | 4/2007 | Koster et al. | |
| 7,501,251 B2 | 3/2009 | Koster et al. | |
| 9,611,283 B1 * | 4/2017 | Zhang ................. | A61K 31/675 |
| 2009/0239764 A1 * | 9/2009 | Sparks ................. | C12Q 1/6827 506/9 |

FOREIGN PATENT DOCUMENTS

| | | |
|---|---|---|
| WO | 1997/037041 A2 | 10/1997 |
| WO | 2007/084631 A2 | 7/2007 |
| WO | 2011/140187 A2 | 11/2011 |

OTHER PUBLICATIONS

Iafrate et al., Detection of large-scale variationin the human genome. Nature Genetics 36(9) : 949 (Year: 2004).*
Kaminski et al.,131I-Tositumomab Therapy as Initial Treatment for Follicular Lymphoma. New England J. of Medicine 352 (5) :441 (2005). (Year: 2000)*
Kokorisa et al., Molecular Diagnosis 5(4) : 329 (Year: 2000).*
Kong et al.,dbCRID: a database of chromosomal rearrangements in human diseases. Nucleic Acids Research 39: D895 (Year: 2011).*
Korbel et al., Paired-End Mapping Reveals Extensive Structural Variation in the Human Genome. Science 318 :420 (Year: 2007).*
Palanisamy et al., Rearrangements of the RAF kinase pathway in prostate cancer, gastric cancer and melanoma. Nature Medicine 16(7) : 793 (Year: 2010).*
Shaw et al.,Clinical Features and Outcome of Patients With Non-Small-Cell Lung Cancer Who Harbor EML4-ALK. J. of Clinical Oncology 27(26) : 4247 (Year: 2009).*
Steidl et al., MHC class II transactivator CIITA is a recurrent gene fusion partner in lymphoid cancers. Nature 471: 377 (Year: 2011).*
Yoshida et al., Immunohistochemical detection of ROS1 isuseful for identifying ROS1 rearrangements in lung cancers. Modern Pathology 27 :711 (published online Nov. 1, 2013). (Year: 2013).*
Zhang et aL., Complex human chromosomal and genomic rearrangements. Trends in Genetics 25(7) :298 (Year: 2009)*
Bergethon et al.; Journal of Clinical Oncology; 2012; 30:8 863-870.
Chamberlain et al., Nucleic Acids Research; 16 (23): 11141-11156, 1988.
Crain et al. (Mass Spectrometry Reviews, 9, 505-554; 1990).
Huijsmans1 et al., BMC Research Notes, 3:239, 2010.
Jahr et al., Cancer Res. 61: 1659-1665, 2001.
Koivunen et al.; Clin Cancer Res.; 2008; 14(13): 4275-4283.
Mouliere et al., PLoS One.;6(9):e23418, 2011.
Neddleman and Wunsch (1970) J. Mol. Biol. 48:443.

(Continued)

*Primary Examiner* — Ethan C Whisenant
(74) *Attorney, Agent, or Firm* — Banner & Witcoff, Ltd.

(57) ABSTRACT

An object of the invention is an in vitro method for detecting chromosomal rearrangements between at least two specific chromosomal regions in a biological sample of a human subject, which comprises the steps of: a) isolating deoxyribonucleic acid (DNA) molecules comprising said specific chromosomal regions from said biological sample, wherein said DNA molecules have an average length of X base pairs; b)amplifying the DNA molecules of step a) by a multiplex polymerase chain reaction assay, said assay comprising at least two sets of primers, wherein each set of primers is capable of hybridizing with a specific reference chromosomal region, and each set of primer comprises a plurality of primers, said primers being capable of hybridizing to a nucleic acid strand of one of the said specific chromosomal regions at sites regularly spaced of less than X/2 base pairs; and hybridizing the product of the amplification of step b) with at least one set of nucleic probes.

19 Claims, 2 Drawing Sheets

Figure 1:
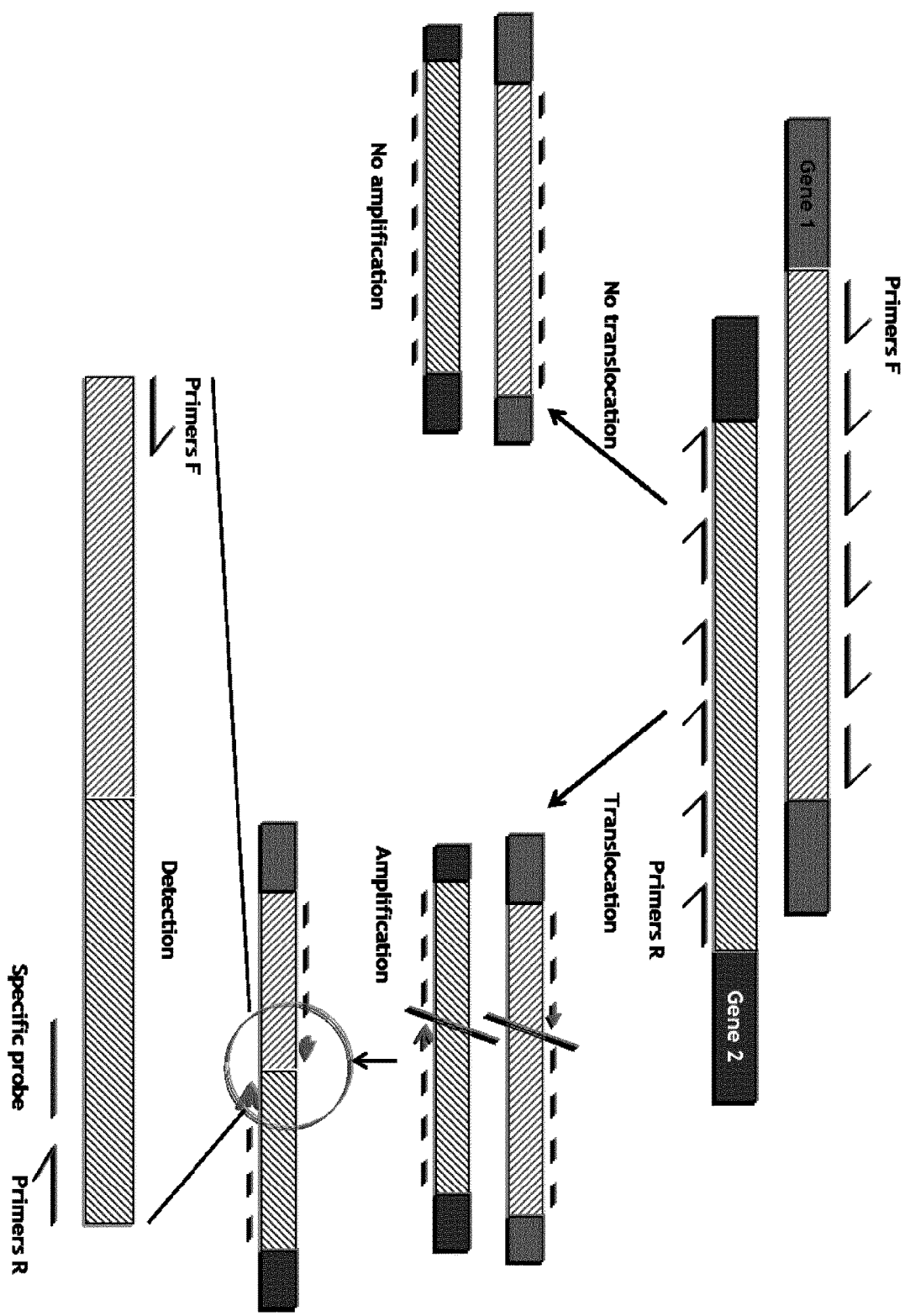

Specification includes a Sequence Listing.

(56) References Cited

OTHER PUBLICATIONS

Pearson and Lipman (1988) Proc. Natl. Acad. Sci. USA 85:2444.
Sato, et al. "Comparison of the DNA Extraction Methods for Polymerase Chain Reaction Amplification from Formalin-Fixed and Paraffin-Embedded Tissues," Diagnostic Molecular Pathology; 10: 4; 265-271; 2001.
Schwarzenbach et al., Nat Rev Cancer. 11(6): 426-437, 2011.
Shaw et al., N Engl J Med. Sep. 27, 2014. [Epub ahead of print].
Singh et al, Science. Sep. 7, 2012;337(6099):1231-5. doi: 10.1126.
Smith and Waterman (1981) [Ad. App. Math. 2:482.
Tatusova et al., FEMS Microbiol., 1999, Lett. 174:247-250.

International Search Report Issued in Corresponding International Application No. PCT/EP2014/075318, dated Feb. 23, 2015.
Cai et al., ROS1 Fusions in Chinese Patients With Non-Small-Cell Lung Cancer, Annals of Oncology, vol. 24, No. 7, Mar. 20, 2013, pp. 1822-1827.
Ming-Tseh Lin et al., D-PCR, A Simple Method to Detect Translocations and Insertion/Deletion Mutations, The Journal of Molecular Diagnostics, vol. 13, No. 1, Jan. 2011, pp. 85-92.
Soda et al., A Prospective PCR-Based Screening for the EML4-ALK Oncogene in Non-Small Cell Lung Cancer, Clinical Cancer Research, vol. 18, No. 20, Oct. 15, 2012, pp. 5682-5689.
Spence et al., Demonstration of Array-Based Analysis for Highly Multiplexed PCR Assays, Journal of Molecular Diagnostics, vol. 13, No. 3, May 2011, pp. 252-262.

\* cited by examiner

METHOD FOR DETECTING CHROMOSOMAL REARRANGEMENTS

RELATED APPLICATION DATA

This application is a National Stage Application under 35 U.S.C. 371 of co-pending PCT application number PCT/EP2014/075318 designating the United States and filed Nov. 21, 2014; which claims the benefit of EP application number 13306589.6 and filed Nov. 21, 2013, each of which are hereby incorporated herein by reference in their entireties.

Numerous chromosomal rearrangements have been associated with the development of particular pathologies. Interestingly, some rearrangements have also been associated with a greater sensitivity to specific treatments.

For example, chromosomal rearrangements that fuse various 5' partners with the 3' kinase domain of the anaplastic lymphoma kinase (ALK) gene, have been described in several malignancies, including non-small cell lung cancer (NSCLC). In humans, the echinoderm microtubule-associated protein-like 4 (EML4) gene, the kinesin family member 5B (KIF5B) gene and the TRK-fused (TFG) gene have been found to be fusion partners for the ALK gene. In lung cancer, the most common 5' fusion partner for the ALK gene is the EML4 gene.

More particularly, it has been shown that a subset of cancer like non-small cell lung cancer (NSCLC) patients harbors rearrangements between the ALK gene and the EML4 gene that lead to a fusion gene called the EML4-ALK fusion oncogene. It was further demonstrated that such rearrangements are associated with an increased efficacy of ALK kinase inhibitors in the treatment of non-small cell lung cancers (Koivunen et al.; Clin Cancer Res.; 2008; 14(13): 4275-4283).

In addition, chromosomal rearrangements involving the proto-oncogene tyrosine-protein kinase gene ROS1 have also recently been described in a subset of non-small-cell lung cancers, and also seem to correlate with a greater sensitivity to the anti-cancer drug crizotinib (Bergethon et al.; Journal of Clinical Oncology; 2012; 30:8 863-870). More specifically, crizotinib seems to show high activity in patients with advanced ROS1-rearranged NSCLC; hence, ROS1 rearrangements, e.g. with CD74, EZR, or SLC34A2, seems to define a second molecular subgroup of NSCLC for which crizotinib is highly active in cancer samples seem to be associated with a good response to the anti-cancer drug crizotinib (see e.g. Shaw et al., N Engl J Med. 2014 Sep. 27. [Epub ahead of print]).

Other chromosomal rearrangements, involving other genes than ALK or ROS have also been identified as potentially targeted by drugs. These are for example FGFR3-TACC3 (Singh D1, Chan J M, Zoppoli P, Niola F, Sullivan R, Castano A, Liu E M, Reichel J, Porrati P, Pellegatta S, Qiu K, Gao Z, Ceccarelli M, Riccardi R, Brat D J, Guha A, Aldape K, Golfinos J G, Zagzag D, Mikkelsen T, Finocchiaro G, Lasorella A, Rabadan R, lavarone A., Science. 2012 Sep. 7; 337(6099):1231-5. doi: 10.1126). The provisions of sensitive methods for the detection of chromosomal rearrangements, for example in a tumor sample from a patient, is thus critical for both diagnosis and prognosis purposes.

Chromosomal rearrangement are often caused by a breakage in the DNA (deoxyribonucleic acid) double helix at two different locations, followed by a rejoining of the broken ends to produce a new chromosomal arrangement of genes, different from the gene order of the chromosomes before they were broken. The breakage in the DNA may occur at various locations among individuals.

For instance, chromosomal rearrangements leading to the formation of the EML4-ALK fusion oncogene do not always occur at the same rupture point. At least 11 EML4-ALK protein variants have been reported to date and several of them have already been correlated with an increased efficacy of ALK kinase inhibitors, more particularly of the anti-cancer drug crizotinib. Those EML4-ALK variants include at least EML4-ALK E6;A19, EML4-ALK E6;A20, and EML4-ALK E13;A20.

The resulting change in the sequence of the DNA thus cannot be anticipated. This uncertainty regarding the location of the rupture point imposes limitations on the techniques that can be used to detect the chromosome rearrangement. It makes it difficult for example to design appropriate primer sets for amplifying the rearranged DNA, and as a consequence to rely on techniques based on polymerase chain reaction (also called PCR-based techniques).

Moreover, and particularly in the case of malignancies, the techniques available to the skilled person for the detection of chromosomal rearrangements are narrowed by technical issues associated with the quantity and quality of the biological sample to be analyzed.

For instance, when the tumor is a solid lesion, a biopsy sample may be necessary for the detection of the rearrangements. Biopsy samples are very often treated to ensure preservation following collection, which may involve fixation of the tissue sample, thereby causing DNA fragmentation and cross-linking.

For example, formalin-fixed paraffin-embedded (FFPE) preparation is the worldwide most simple and therefore most frequently applied method of biobanking by the pathologists, as well as the standard reference material used for the primary histological diagnosis of cancer by histopathologists. FFPE samples thus represent the most commonly used source of biological material for the detection of chromosomal rearrangements in solid tumors. However, the DNA present in FFPE samples is not intact: the average size of DNA fragments in paraffin-embedded tissue samples ranges from about 200 to 600 base pairs.

Lately, cell-free DNA found in blood and blood-derived samples has also been used to detect mutations or rearrangements in patients, since it is known that circulating ("cell-free") tumor DNA may also be found in samples such as blood, plasma or serum. Yet, cell-free DNA is usually scarce and fragmented (Mouliere et al., *PLoS One.*; 6(9):e23418, 2011). Indeed, it is known that the average size of cell-free DNA fragments ranges from about 70 to 200 base pairs, although fragments as large as 10,000 bp could also be identified (Jahr et al., *Cancer Res.* 61: 1659-1665, 2001; Schwarzenbach et al., *Nat Rev Cancer.* 11(6): 426-437, 2011).

Thus, in most cases, the person skilled in the art is confronted with the scarcity of biological material, and thus is limited to detection techniques that can provide a specific and sensitive detection with very little of the biological sample. Furthermore, in most type of relevant samples, the available DNA is fragmented.

Moreover, because of the random position of the breakage, PCR-based techniques detecting chromosome rearrangements must be long range PCR-based techniques requiring DNA sufficiently preserved. These methods are not applicable to FFPE DNA. DNA fragmentation reduces the sensitivity of PCR-based techniques, as the locus of interest may not be amplified or may not hybridize with the primers correctly.

For the above reasons, the most commonly used methods for detecting chromosome rearrangements are either FISH techniques, or RT-PCR on mRNA extracted from the samples.

FISH (fluorescence in situ hybridization) is a cytogenetic technique, which is often used for finding specific features in DNA. FISH uses fluorescent probes that bind to only those parts of the chromosome with which they show a high degree of sequence complementarity with. FISH can be used to detect and localize the presence or absence of specific DNA sequences on chromosomes, and thus chromosome rearrangements. Its implementation however requires highly trained technicians and physicians, comprises many steps and remains difficult to interpret.

As for RT-PCR on mRNA, it cannot be systematically used as a routine technique. Indeed, there is very little amount of mRNA in samples such as paraffin-embedded tissue sample, mRNAs could be damaged by formol fixation and paraffin embedding. The difficulty of this technique will be correlated to the number of variants. This technique can only be used as a confirmation of a diagnosis when the quantity of sample is limited.

There is thus still a need for improved methods to detect easily and rapidly chromosome rearrangements that would be suited for use when the DNA in the sample is scarce and/or fragmented. Such methods would be extremely beneficial, as they would then allow diagnosis or prognosis to be made with samples such as paraffin-embedded tissue samples or blood derived samples and in particular samples comprising cell-free DNA derived from blood.

Finally, due to the increased high number of samples that require such diagnosis worldwide, there is also the need to develop method of chromosomal breakpoints rearrangements detection adapted to a high throughput diagnosis.

FIGURE LEGENDS

FIG. 1 illustrates the method of the invention. See the text for details

Figure 2:
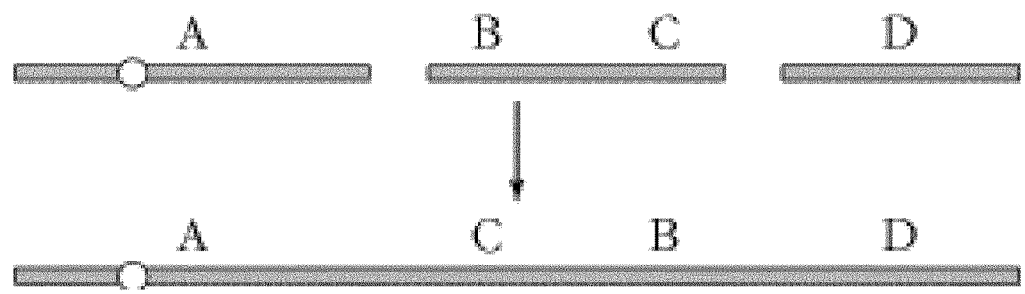

FIG. 2 illustrates molecular events that may lead to an inversion. A segment of a DNA molecule is broken twice (once at each end of said segment), flipped 180 degrees, and rejoined. The lower band represents the DNA molecule resulting from such molecular events.

Figure 3:
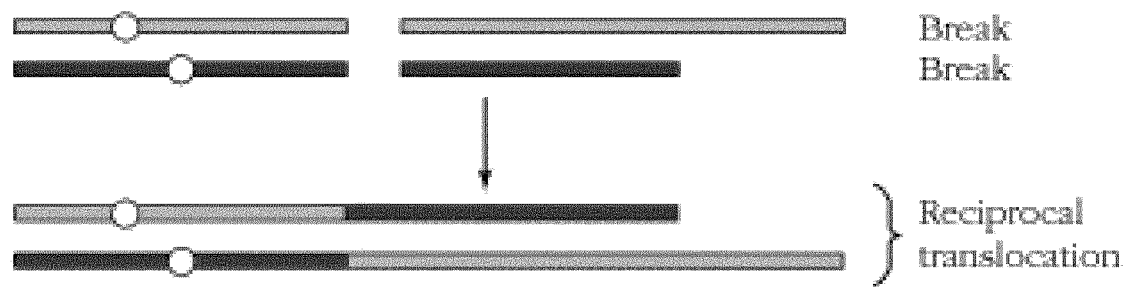

FIG. 3 illustrates molecular events that may lead to a reciprocal translocation. A first chromosome is broken, a segment of a second chromosome is broken, and the segment of the first chromosome is joined to the second chromosome, while the segment of the second chromosome joins the first chromosome. The two lower bands represent the DNA molecules resulting from such molecular events.

DETAILED DESCRIPTION

The inventors have designed a method for detecting chromosome rearrangements that is highly sensitive and very simple to implement. The method of the invention can be performed even when the amount of biological sample is scarce. In addition, the method of the invention can be used for multiplexing, independently of the amount of sample available. Further, the method of the invention can overcome technical issues associated with fragmented DNA. The method of the invention can thus be used even when the quality of the DNA contained in the sample is not guaranteed. Importantly, the method of the invention also enables the direct determination of the breakage point by sequencing.

The method of the invention relies on PCR-based techniques for detecting chromosome rearrangements that occur between at least two specific chromosomal regions. The main advantages of PCR-based techniques are their speed and simplicity of use, the low amounts of DNA required can be performed on the same DNA extracted for mutation screening, and the possibility to use DNA of low quality. Consequently, the method of the invention can be used even when the amount of biological sample is scarce, or when the quality of the DNA it contains is low. For example, the method of the invention allows the use of small biopsies (such as fine needle aspiration biopsies), or the use of formaldehyde-fixed paraffin-embedded samples, which generally results in DNA of low quality.

The method of the invention is illustrated in FIG. 1. Said method uses at least two primer sets, each one comprising primers that hybridize with only one of the two specific chromosomal regions of interest. The primers within a set hybridize and anneal with only one strand of said one of the two specific chromosomal regions of interest.

When the sample does not actually contains a rearrangement between the two specific chromosomal regions of interest, the distance between the chromosomal regions of interest, where the two primer sets hybridize, will be too important to enable amplification of the DNA.

Indeed, in the absence of chromosomal rearrangements between the two specific chromosomal regions of interest, those two regions are not adjacent to each other. Indeed, they are either apart on the same chromosome, or located on two different chromosomes. Yet, because the biological sample to be used is expected to contain fragmented DNA, it is unlikely that it actually contains a fragment that comprises the two chromosomal regions of interest. Consequently, in the absence of chromosomal rearrangement between the two specific chromosomal regions of interest in the biological sample, the PCR will be impaired and will not raise any amplification product.

On the other hand, when the sample actually contains a rearrangement between the two specific chromosomal regions of interest, the distance between the regions where the two primer sets hybridize will be short enough to enable DNA amplification.

Indeed, when the sample comprises a chromosomal rearrangement between the two specific chromosomal regions of interest, said two specific chromosomal regions of interest are then adjacent to each other. In that case, it is likely that primers from both primer sets will be able to anneal to at least one fragment of DNA, and thus enable DNA amplification.

Hence, particularly when using fragmented DNA, the PCR will only raise an amplification product when the biological sample comprises a chromosomal rearrangement between the two specific chromosomal regions of interest.

The method of the invention is thus both highly sensitive and highly specific. In general, the sensitivity of a method measures the ability of the latter to give a positive result when a hypothesis is true, while the specificity measures the ability of a test to give a negative result when the assumption is false. Thus, the sensitivity of a method of detection is estimated by the proportion of samples identified as positive (that is to say as comprising a specific feature) by the method, in samples actually comprising such a feature. The specificity of a method of detection is estimated by the proportion of samples identified as negative (that is to say as not comprising a specific feature) by the method, in samples actually not comprising such a feature.

Detection of rearrangements between two chromosomal regions by PCR-based techniques usually requires precise knowledge of the rearranged segments in order to design appropriate primers at opposite sides of the rupture point.

The invention however does not require such information, as the two sets of primers allow the detection of any rearrangements between two chromosomal regions without previous knowledge of the precise location of the rupture point(s).

A first object of the invention is an in vitro method for detecting chromosomal rearrangements between at least two specific chromosomal regions in a biological sample of a human subject, which comprises the steps of:
 a) isolating deoxyribonucleic acid (DNA) molecules comprising said specific chromosomal regions from said biological sample, wherein said DNA molecules have an average length of X base pairs;
 b) amplifying the DNA molecules of step a) by a multiplex polymerase chain reaction assay,
said assay comprising at least two sets of primers, wherein each set of primers is capable of hybridizing with a specific reference chromosomal region, and
each set of primer comprises a plurality of primers,
said primers being capable of hybridizing to a nucleic acid strand of one of the said specific chromosomal regions at sites regularly spaced of less than X/2 base pairs; and
hybridizing the product of the amplification of step b) with at least one set of nucleic probes.

By "chromosomal rearrangement" it is herein referred to an aberration of the genome resulting from a change in the structure of at least one chromosome, wherein the sequence of the rearranged chromosome is different from the sequence of reference for said chromosome. In the context of the invention, the term "chromosomal rearrangement" encompasses deletions, duplication, inversions, and translocations. By "the sequence of reference for said chromosome" it is herein referred to the sequence for that chromosome present in the majority of human subjects. In the context of the invention, the term "the sequence of reference for said chromosome" encompass sequences of human chromosomes indexed in the Genome Reference Consortium Human Build 37 patch release 12 (GRCh37.p12). Such sequences of reference are well known from the person skilled in the art, and are for example displayed in databases such as the "GENE" database hosted by NCBI (available at the address: http://www.ncbi.nlm.nih.gov/genome/guide/human).

By "deletion" it is herein referred to an aberration of the genome in which one or more nucleotides are missing in a sequence of a chromosome or of a DNA molecule, compared to the sequence of a chromosome or of a DNA molecule of reference.

By "duplication" it is herein referred to an aberration of the genome in which one or more contiguous nucleotides are found in two copies in a sequence of a chromosome or of a DNA molecule, compared to the sequence of a chromosome or of a DNA molecule of reference wherein the same nucleotide are only found in one copy.

By "inversion" it is herein referred to an aberration of the genome in which a segment of the sequence of a chromosome or of a DNA molecule is reversed end to end, compared to a sequence of reference of said chromosome or of said DNA molecule.

For example, an inversion may result from a molecular event in which a segment of a DNA molecule is broken twice (once at each end of said segment), flipped 180 degrees, and rejoined, such as illustrated in FIG. 2. Consequently, the sequence of the chromosome comprising the inversion is different from the sequence of reference of said chromosome in that a segment of the sequence of the chromosome after inversion is reversed end to end.

By "translocation" it is herein referred to an aberration of the genome in which a segment of a chromosome is exchanged with a segment of a separate non-homologous chromosome. According to the invention, the term "translocation" encompasses reciprocal translocation and Robertsonian translocation. By "reciprocal translocation", it is herein referred to a translocation in which the segments of chromosomes that are exchanged are acentric segments of said chromosomes. By "Robertsonian translocation", it is herein referred to a translocation in which segments of chromosomes that are exchanged are acrocentric segments of said chromosomes. By "acentric segment" it is herein referred to a segment of a chromosome that lacks a centromere. By "acrocentric segment" it is herein referred to a segment of a chromosome that comprises a centromere. By "centromere" it is herein referred to the part of a chromosome that links sister chromatids. The centromere of a chromosome can easily be detected, for example by analyzing a karyotype by microscopy, after coloration by Giemsa. Under microscopy, the centromere of a chromosome in a karyotype appears as a constricted region of the chromosome where the two sister chromatids are most closely in contact. By "chromatid" it is herein referred to one copy of a duplicated chromosome. By "sister chromatids" it is herein referred to two copies of a duplicated chromosome that are joined by the centromeres.

For example, a reciprocal translocation may occur after a molecular event in which a segment of a first chromosome is broken, a segment of second chromosome, which is a separate chromosome non-homologous to the first chromosome segment, is broken, and the segment of the first chromosome is joined the second chromosome, while the segment of the second chromosome is joined to the first chromosome, such as illustrated in FIG. 3.

Preferably, the chromosomal rearrangement according to the invention is an inversion or a translocation. In an embodiment, the chromosomal rearrangement according to the invention is an inversion. In another embodiment, the chromosomal rearrangement according to the invention is a translocation.

By "specific chromosomal region" it is herein referred to a specific part of a chromosome defined either by anatomical details, such as banding, or by its nucleotide sequence, such as the genes it comprises.

Many human cancers are associated with characteristic chromosomal rearrangements, especially hematopoietic cancers such as leukemias and lymphomas, but also solid cancers. Various genes, such as e.g. FGFR3, TACC3, BCL-2, E2A, ALL, ABL, BCR, PBX-1, are involved in such rearrangements. In particular, chromosomal rearrangements involving either the anaplastic lymphoma kinase gene (ALK) or the proto-oncogene tyrosine-protein kinase gene (ROS1) have been described for lung cancer. Therefore, said reference chromosomal regions comprise at least one region comprising at least of the genes involved in a cancer-associated chromosomal rearrangement. Preferentially, said reference chromosomal regions comprise at least one region selected from the anaplastic lymphoma kinase gene (ALK) of sequence SEQ ID No.1 and the proto-oncogene tyrosine-protein kinase gene ROS1 of sequence SEQ ID No.5.

As mentioned above, chromosomal rearrangements (inversions and translocations) that fuse various 5' partners with the 3' kinase domain of ALK have been described in several malignancies, including non-small cell lung cancers. In humans, the ELM4 gene (NCBI references: 27436) encodes the Echinoderm microtubule-associated protein-like 4, the KIF5B gene (NCBI references: 3799) encodes the Kinesin-1 heavy chain protein and the TRK-fused gene, also called the TFG gene (NCBI references: 10342), encodes the protein TFG. All of those genes have been found to be fusion partners for the ALK gene. In lung cancer, the most common 5' fusion partner for ALK is EML4.

The detection of chromosomal rearrangements involving those genes is thus of critical importance, particularly in the prognosis of lung cancer.

In an embodiment, said reference chromosomal regions comprise at least the anaplastic lymphoma kinase gene (ALK) of sequence SEQ ID No.1.

In a preferred embodiment, said reference chromosomal regions comprise at least the anaplastic lymphoma kinase gene (ALK) of SEQ ID No.1 and the kinesin family member 5B gene (KIF5B) of sequence SEQ ID No.2.

In another preferred embodiment, said reference chromosomal regions comprise at least the anaplastic lymphoma kinase gene (ALK) of SEQ ID No.1 and the TFG gene (TFG) of sequence SEQ ID No.3.

In yet another preferred embodiment, said reference chromosomal regions comprise at least the anaplastic lymphoma kinase gene (ALK) of SEQ ID No.1 and the echinoderm microtubule-associated protein-like 4 gene (EML4) of sequence SEQ ID No.4.

On the other hand, chromosomal rearrangements involving the Proto-oncogene tyrosine-protein kinase gene ROS1 have also recently been described in a subset of non-small-cell lung cancers, as well as in other cancers like chlangio-carcinomas or melanomas. The presence of such rearrangements seems to correlate with a greater sensitivity to the anti-cancer drug crizotinib (Bergethon et al.; *Journal of Clinical Oncology*; 2012; 30:8 863-870). As mentioned above, chromosomal rearrangements involving ROS1 and either the CD74, EZR or SLC34A2 gene in cancer samples seem to confer high sensitivity to the anti-cancer drug like crizotinib, but rearrangements involving ROS1and other genes are also known. Methods for determining the presence of such rearrangements in biological sample are therefore of particular interest.

In humans, the CD74 gene (NCBI reference: 972) encodes the HLA class II histocompatibility antigen gamma chain, also known as HLA-DR antigens-associated invariant chain or CD74 protein; the EZR gene (NCBI reference: 7430) encodes the ezrin protein, also known as cytovillin or villin-2; and the SLC34A2 gene (NCBI reference: 10568), encodes the sodium-dependent phosphate transport protein 2B. All of those genes have been found to be fusion partners for the ROS1 gene.

Thus, in another embodiment, said reference chromosomal regions comprise the proto-oncogene tyrosine-protein kinase gene ROS1 of sequence SEQ ID No.5.

In a preferred embodiment, said reference chromosomal regions comprise the proto-oncogene tyrosine-protein kinase gene ROS1 of sequence SEQ ID No.5 and the CD74 gene (CD74) of sequence SEQ ID No.312.

In another preferred embodiment, said reference chromosomal regions comprise the proto-oncogene tyrosine-protein kinase gene ROS1 of sequence SEQ ID No.5 and the EZR gene (EZR) of sequence SEQ ID No.313.

In yet another preferred embodiment, said reference chromosomal regions comprise the proto-oncogene tyrosine-protein kinase gene ROS1 of sequence SEQ ID No.5 and the SLC34A2 gene (SLC34A2) of sequence SEQ ID No.314.

The method of the invention is performed using a biological sample of the subject to be tested. In an embodiment, the method of the invention further comprises a preliminary step of taking a biological sample from the subject. The term "subject" refers to a human and includes male and female subjects. In the sense of the present invention, the terms "patient" or "subject" may be used interchangeably.

According to the invention, the term "biological sample" refers to a sample of biological tissue from a subject, its cells or component parts, which comprise DNA from said subject. "A biological sample" further refers to a homogenate, lysate or extract prepared from a sample of biological tissue from a subject, its cells or component parts, or a fraction or portion thereof, that comprise DNA from said subject. Preferably, the DNA from said subject is genomic DNA. By "genomic DNA" it is herein referred to deoxyribonucleic acids which sequence is identical to that of the genome of the subject. The terms "genomic DNA" encompass DNA that may have undergone purification, or fragmentation. Most often, the biological sample has been removed from a subject. Biological samples can be collected from a subject using any standard method known in the art that results in the preservation of nucleic acids.

The method of the invention can be used to analyze any type of biological sample comprising chromosomal DNA. Yet, it is particularly appropriate for detecting chromosomal rearrangement in biological samples comprising fragmented DNA. For example, the method of the invention is particularly suited for detecting chromosomal rearrangements in samples obtained from solid tumors. Thus, in an embodiment, the biological sample is a tissue sample. In a preferred embodiment, the biological sample is a tumor tissue.

It is further well known that circulating tumor DNA may also be found in liquid samples such as blood, plasma or serum. Although conventional tumor biopsies are preferable, these often cannot be obtained for logistic or medical reasons. When tumor tissue specimens from patients are unavailable, liquid samples offer an alternative that can be rapidly implemented without the pain, risk, and expense entailed by a biopsy of one of the metastatic lesions. As such DNA is usually scarce and fragmented (Mouliere et al., *PLoS One.*; 6(9):e23418, 2011), the method of the invention is of particular interest for detecting chromosomal rearrangement in this type of sample. Moreover FISH or imunohistochemistry are not applicable in this kind of samples. In another embodiment, the biological sample is a blood-derived sample, such as e.g. blood, plasma or serum.

The method of the invention is suited for detecting chromosomal rearrangement in any type of tissue or of tumor.

In an embodiment, said tumor is selected from the group consisting of carcinoma, including that of the bladder, brain, breast, colon, kidney, liver, lung, ovary, pancreas, stomach, cervix, thyroid and skin; including squamous cell carcinoma; tumors of mesenchymal origin, including fibrosarcoma and rhabdomyoscarcoma; other tumors, including melanoma, seminoma, tetratocarcinoma, neuroblastoma and glioma; tumors of the central and peripheral nervous system, including astrocytoma, neuroblastoma, glioma, and schwannomas; tumors of mesenchymal origin, including fibrosarcoma, rhabdomyoscarama, and osteosarcoma; and other tumors, including melanoma, xeroderma pigmentosum, keratoactanthoma, seminoma, thyroid follicular cancer and teratocarcinoma.

Of particular interest in the invention are lung cancers. Indeed, as explained above, lung cancer patients, and particularly non-small-cell lung cancer patients (also called non-small-cell lung carcinoma patients) may harbor specific chromosomal rearrangement correlated with a greater sensitivity to specific treatments.

According to the invention lung cancer comprises non-small-cell lung cancer, small-cell lung cancer, glandular tumors, carcinoid tumors, and undifferentiated carcinomas.

According to the invention non-small-cell lung cancer comprises adenocarcinoma, squamous-cell lung carcinoma, and large-cell lung carcinoma.

Preferably, the biological sample is a tumor tissue wherein the tumor is lung cancer. Yet preferably, the biological sample is a tumor tissue wherein the tumor is non-small-cell lung cancer.

Tissue samples, particularly tumor tissue, may be obtained for example from biopsies from the subject. Biopsies can be collected using standard techniques such as needle biopsy or surgical excision.

Alternatively, the biological sample may be a blood-derived sample, such as blood, plasma or serum. Such a kind of sample is known to contain cell-free tumor DNA and can be easily collected by methods known in the art.

According to the invention, the biological sample can be assayed for chromosomal rearrangements in a target DNA sequence immediately following collection. Alternatively, or in addition, a biological sample can be stored for later analysis using methods known in the art. For example, a sample can be frozen, dried, freeze-dried or subject to chemical fixation For instance, tissue samples such as e.g. biopsies may be subjected to formalin fixed and paraffin-embedded (FFPE) chemical fixation. These operations are routinely performed in clinical laboratories, and need not be detailed here. In an embodiment, said biological sample is a FFPE tissue sample. On the other hand, blood-derived samples will most advantageously be stored by freezing.

Once a biological sample is available, it is then possible to isolate the DNA molecules it contains, in particular DNA molecules comprising the at least two specific chromosomal regions expected to be involved in a chromosomal rearrangement.

Isolation of DNA molecules from cell or a tissue sample is only routine procedure well known to those skilled in the art. Standard methods of preparation of a DNA sample include for example DNA extraction by heating or with organic solvents, such as for example phenol, chloroform, isoamyl alcohol or a combination thereof. Commercially available purification reagents and kits can also be used such as kits commercialized by for example, QIAGEN (Valencia, Calif.), Invitrogen (Carlsbad, Calif.), and Stratagene (La Jolla, Calif.). Optionally, the purification can be automated. DNA can be partially or substantially purified from the biological sample.

In some embodiments, such as for example when the biological sample has been submitted to chemical fixation after collection, the method of the invention further comprises a step of preparing the biological sample before isolation of DNA.

By "preparing the biological sample" it is herein referred to treating the biological sample in view of facilitating isolation of DNA. According to the invention, the person skilled in the art can facilitate isolation of DNA by extracting cells or tissues from the biological samples, or by removing chemical from previous fixation treatment.

Preferably, the method of the invention comprises a step of removing paraffin from the FFPE tissue sample. Techniques for removing paraffin before DNA isolation are commonly used by the person skilled in the art. For example, in a typical method for removing paraffin, the tissue is washed several times in xylene to dissolve the paraffin, and then the xylene is removed by performing multiple washes with ethanol before DNA isolation. Those steps are routine work for the person skilled in the art, who can refer for example to Sato et al. for more detailed examples of protocols (*Diagnostic Molecular Pathology;* 10: 4; 265-271; 2001). It is also possible to use commercial solutions (e.g. BiOstic® Paraffin Removal Reagent, MO BIO Laboratories, Carlsbad, Calif. USA). More generally, any method known to the person of skills in the art for removing paraffin is equally convenient.

Once DNA has been isolated, the person skilled in the art can optionally verify that the isolated DNA is appropriate for the intended analysis. For instance, the person skilled in the art can detect whether the isolated DNA actually comprises the said specific chromosomal regions of interest. Thus, in an embodiment, the invention further comprises a step of detecting that the DNA from step a) comprises the specific chromosomal regions. Preferably, detecting that the isolated DNA actually comprises the specific chromosomal regions is performed before or after performing the method of the invention. In another embodiment, detecting that the isolated DNA actually comprises the specific chromosomal regions is performed in a separate analysis.

Any known technique can be used to detect that the DNA molecules isolated from the biological sample comprise the specific chromosomal regions as defined above, such as for example hybridization with oligonucleotide probes capable of hybridizing with the specific chromosomal regions.

By "capable of hybridizing" it is herein referred to the capacity for a polynucleotide of hybridizing with another polynucleotide of a specific sequence at least under standard hybridization conditions, and preferably under stringent conditions. By "hybridization" it is herein referred to the process whereby two polynucleotides undergo base pairing interactions. Two polynucleotides are said to be hybridized when any portion of one polynucleotide is base paired with any portion of the other polynucleotide. It is not necessarily required that the polynucleotides be hybridized across their entire respective lengths. In some embodiments, at least one of the polynucleotide can include portions which are not hybridized to the other polynucleotide. According to the invention, the terms "standard hybridization conditions" refer to conditions under which hybridization of a polynucleotide, such as a probe or a primer, to another polynucleotide, such as a DNA molecule, occurs in the presence of low hybridization temperature and high ionic strength. In one exemplary embodiment, standard hybridization conditions include an aqueous environment containing about 100 mM magnesium sulfate, about 500 mM Tris-sulfate at pH 8.9, and about 200 mM ammonium sulfate at about 50-55° C., or equivalents thereof. The phrase "hybridizing under stringent conditions" refer to conditions under which hybridization of a polynucleotide, such as a probe or a primer, to another polynucleotide, such as a DNA molecule, occurs in the presence of high hybridization temperature and low ionic strength. In one, exemplary embodiment, stringent hybridization conditions include an aqueous environment containing about 30 mM magnesium sulfate, about 300 mM Tris-sulfate at pH 8.9, and about 90 mM ammonium sulfate at about 60-68° C., or equivalents thereof.

In the context of the invention, the DNA molecules isolated in step a) have an average length which is represented by the symbol X.

By "average length of the DNA molecules", it is herein referred to the average length of the DNA molecules which have been isolated from the biological sample. According to the invention, the average length of the DNA molecules is the arithmetic mean of the length of DNA molecules which have been isolated from the biological sample. In the context of the invention, the average length of the DNA molecules is expressed in base pairs. The average length of the DNA molecules in a DNA sample after the isolation step can for example be measured by agarose gel using electrophoresis. Such techniques are quite common to the skilled person and do not need to be further detailed here. For additional information, the skilled person may for instance refer to Sambrook et al.

The average length of the DNA molecule impacts the amplification step. Indeed, the shorter the DNA molecules are, the less likely primers and probes are to hybridize with at least one of those molecules. The inventors have however adapted the design of the primers and of the probes of the invention to the average length of the DNA molecules they target. The average length of the DNA molecules in the biological sample is thus a technical feature of the invention, used to determine other features of the invention, such as the primers used for the amplification step, or some of the probes used in the hybridization step.

According to the invention X is an integer, that is to say a number that can be written without a fractional or decimal component. The average size of DNA molecules after isolation may vary from the isolation technique, and further from the sample they originate from. For example, it is well known that paraffin-embedded tissue sample contains DNA that has been fragmented as a result of the formalin fixation. Paraffin-embedded tissue sample usually contains DNA molecules which average length is inferior or equal to 600 base pairs (Huijsmans1 et al., *BMC Research Notes*, 3:239, 2010), whereas the average length of the cell-free DNA found in blood-derived samples may be inferior or equal to 200 bp (Jahr et al., *Cancer Res.* 61: 1659-1665, 2001; Schwarzenbach et al., *Nat Rev Cancer.* 11(6): 426-437, 2011). Preferably, X is inferior or equal to 600. More preferably, X is inferior or equal to 400. Still more preferably, X is inferior or equal to 350, preferably to 300, more preferably to 250, still more preferably to 200.

The method of the invention is suited for samples comprising DNA molecules of any length, such as FFPE samples that may comprise DNA molecules of an average length of 600 base pairs or less. It is also advantageous to use the method of the invention for detecting chromosomal rearrangements in biological samples containing cell-free DNA, for example in blood-derived samples since they are known to contain DNA fragments with an average length of 200 base pair or less.

Thus, preferably, in the in vitro method for detecting chromosomal rearrangements the DNA molecules are characterized in that they have an average length inferior or equal to 600 base pairs. The method of the invention enables the detection of any rearrangement between two specific regions of interest, even when working with short isolated DNA molecules.

Therefore, the sets of primers of the invention are specifically designed to ascertain that at least one primer will actually hybridize with the DNA comprising the chromosomal rearrangement, even when the DNA molecules isolated from the biological sample are of a particularly short length.

According to the invention, the primers within a set are capable of hybridizing to a nucleic acid strand of one of the said specific chromosomal region. More precisely, all of the primers within a set are capable of hybridizing to the same nucleic acid strand of one of the said specific chromosomal region. In other terms, according to the invention, all of the primers within any specific set of primers hybridize with the same nucleic acid strand of one specific chromosomal region. This first aspect ensures that no spurious amplification takes place within one specific chromosomal region.

The design of the different primers can easily be modified by the person skilled in the art, who can thus adapt the minimal distance between two consecutively hybridized primers according to the expected size of DNA molecules in the sample. The method of the invention thus enables to detect rearrangements even in FFPE samples or blood-derived samples.

By "primers", it is herein referred to any polynucleotide capable of hybridizing with a target sequence of interest and can also serve to prime nucleic acid synthesis. In the context of the invention, the term "primers" refers to single stranded DNA molecules (ssDNA). The primer can become incorporated into the synthesized nucleic acid strand and provide a site to which another primer can hybridize to prime synthesis of a new strand that is complementary to the synthesized nucleic acid molecule. The primer can be composed of any combination of nucleotides or analogs thereof, which may be linked to form a linear polymer of any suitable length. For example, the primer can be a single-stranded oligonucleotide or polynucleotide. Primers sequences vary according to the target sequence of interest. Factors governing the choice of specific primers include, but are not limited to, the G/C content of the primer, the primer length desired, the melting temperature of the primer-target DNA, the selectivity of the primer for the target sequence and the location of the corresponding sequences within the DNA of the target nucleic acid. Those factors are well known from the person skilled in the art.

By "a set of primers", it is herein referred to a plurality of primers comprising at least two primers.

In the context of the invention, each set of primers is capable of hybridizing with a specific chromosomal region, preferably under standard hybridization conditions.

The present invention sets forth sets of primers that can be safely used in particular to detect rearrangements between the ALK gene and the EML4 gene in FFPE samples or blood-derived samples. Those sets of primers can thus also be used to detect the same ALK/ELM4 rearrangement in any type of biological sample, and particularly in biological samples wherein the DNA is scarce and fragmented.

In an embodiment, one of the sets of primers of the invention comprises primers designed to detect rearrangements involving the ALK gene. Preferably, a primer designed to detect rearrangements involving the ALK gene is chosen in the list consisting in primers of sequences SEQ ID No. 6 to 45.

In a preferred embodiment, another set of the sets of primers of the invention comprises primers designed to detect rearrangements involving the EML4 gene. Preferably, a primer designed to detect rearrangements involving the EML4 gene is chosen in the list consisting in primers designed to detect the ALK/ELM4 variant 1 rearrangement, primers designed to detect the ALK/ELM4 variant 2 rearrangement, primers designed to detect the ALK/ELM4 variant 3 rearrangement.

By "ALK/ELM4 variant 1 rearrangement" it is herein referred to the chromosome rearrangement of sequence SEQ ID No.270. Preferably, a primer designed to detect the ALK/ELM4 variant 1 rearrangement is a primer chosen in the list consisting of primers of sequences SEQ ID No. 46 to 102.

By "ALK/ELM4 variant 2 rearrangement" it is herein referred to the chromosome rearrangement of sequence SEQ ID No.271. Preferably, a primer designed to detect the ALK/ELM4 variant 2 rearrangement is a primer chosen in the list consisting of primers of sequences SEQ ID No. 103 to 108.

By "ALK/ELM4 variant 3 rearrangement" it is herein referred to it is herein referred to the chromosome rearrangement of sequence SEQ ID No.272. Preferably, a primer designed to detect the ALK/ELM4 variant 3 rearrangement is a primer chosen in the list consisting of primers of sequences SEQ ID No. 109 to 269.

The present invention also provides sets of primers which can be used for detecting chromosomal rearrangements involving the ROS1. These sets of primers can be safely used in particular to detect rearrangements between the ROS1 gene and any of the CD74, EZR, or SLC34A2 genes in FFPE samples or blood-derived samples. Those sets of primers can thus also be used to detect the same rearrangement between ROS1 and CD74, EZR, or SLC34A2 in any type of biological sample, and particularly in biological samples wherein the DNA is scarce and fragmented.

Thus, in this embodiment, one of the sets of primers of the invention comprises primers designed to detect rearrangements involving the ROS1 gene. Preferably, a primer designed to detect rearrangements involving the ROS1 gene is chosen in the list consisting in primers of sequences SEQ ID No. 365 to 470.

In a preferred embodiment, a set of primers according to the invention comprises primers designed to detect rearrangements involving the ROS1 gene and selected in the list consisting in primers designed to detect the ROS1/CD74 variant 1 rearrangement, primers designed to detect the ROS1/EZR variant 2 rearrangement, primers designed to detect the ROS1/SLC34A2 variant 3 rearrangement.

By "ROS1/CD74 variant 1 rearrangement" it is herein referred to a chromosome rearrangement between the ROS1 gene of sequence SEQ ID NO. 5 and the CD74 gene of sequence SEQ ID No. 312. Preferably, a primer designed to detect the ROS1/CD74 variant 1 rearrangement is a primer chosen in the list consisting of primers of sequences SEQ ID No. 315 to 328 and SEQ ID No. 433 to 451.

By "ROS1/EZR variant 2 rearrangement" it is herein referred to the chromosome rearrangement between the ROS1 gene of sequence SEQ ID NO. 5 and the EZR gene of sequence SEQ ID No. 313. Preferably, a primer designed to detect the ROS1/EZR variant 2 rearrangement is a primer chosen in the list consisting of primers of sequences SEQ ID No. 329 to 336 and SEQ ID No. 433 to 451.

By "ROS1/SLC34A2 variant 3 rearrangement" it is herein referred to it is herein referred to the chromosome rearrangement between the ROS1 gene of sequence SEQ ID NO. 5 and the SLC34A2 gene of sequence SEQ ID No. 314. Preferably, a primer designed to detect the ROS1/SLC34A2 variant 3 rearrangement is a primer chosen in the list consisting of primers of sequences SEQ ID No. 337 to 432.

The sets of primers are used in a multiplex polymerase chain reaction assay to amplify the DNA molecules in the sample, in particular the DNA molecules that comprise the rearrangement of interest.

By "amplifying" it is herein referred to any action or process whereby at least a portion of a first polynucleotide (also referred to as a template polynucleotide) is replicated or copied into at least one additional polynucleotide. The additional polynucleotide optionally has a sequence that is substantially identical or substantially complementary to at least some portion of the polynucleotide. By "substantially identical", it is herein referred to two polynucleotides which sequences have at least 99% identity. According to the invention, two polynucleotides are "substantially complementary", when the sequence of one polynucleotide has at least 99% identity with the complementary sequence of the other polynucleotide.

The template polynucleotide of the amplification reaction can be single-stranded or double-stranded and the resulting additional polynucleotides can independently be single-stranded or double-stranded. In some embodiments, amplification includes an enzyme-catalyzed reaction for the production of at least one copy of at least some portion of the template polynucleotide or the production of at least one copy of a polynucleotide that is complementary to at least some portion of the template polynucleotide.

According to the present invention, the "percentage identity" between two sequences of nucleic acids or amino acids means the percentage of identical nucleotides or amino acid residues between the two sequences to be compared, obtained after optimal alignment, this percentage being purely statistical and the differences between the two sequences being distributed randomly along their length. The comparison of two nucleic acid or amino acid sequences is traditionally carried out by comparing the sequences after having optimally aligned them, said comparison being able to be conducted by segment or by using an "alignment window". Optimal alignment of the sequences for comparison can be carried out, in addition to comparison by hand, by means of the local homology algorithm of Smith and Waterman (1981) [Ad. App. Math. 2:482], by means of the local homology algorithm of Neddleman and Wunsch (1970) [J. Mol. Biol. 48:443], by means of the similarity search method of Pearson and Lipman (1988) [Proc. Natl. Acad. Sci. USA 85:2444] or by means of computer software using these algorithms (GAP, BESTFIT, FASTA and TFASTA in the Wisconsin Genetics Software Package, Genetics Computer Group, 575 Science Dr., Madison, Wis., or by the comparison software BLAST NR or BLAST P).

The percentage identity between two nucleic acid or amino acid sequences is determined by comparing the two optimally-aligned sequences in which the nucleic acid or amino acid sequence to compare can have additions or deletions compared to the reference sequence for optimal alignment between the two sequences. Percentage identity is calculated by determining the number of positions at which the amino acid nucleotide or residue is identical between the two sequences, preferably between the two complete sequences, dividing the number of identical positions by the total number of positions in the alignment window and multiplying the result by 100 to obtain the percentage identity between the two sequences.

For example, the BLAST program, "BLAST 2 sequences" (Tatusova et al., "Blast 2 sequences—a new tool for comparing protein and nucleotide sequences", FEMS Microbiol., 1999, Lett. 174:247-250) available on the site http://www.ncbi.nlm.nih.gov/gorf/bl2.html, can be used with the default parameters (notably for the parameters "open gap penalty": 5, and "extension gap penalty": 2; the selected matrix being for example the "BLOSUM 62" matrix proposed by the program); the percentage identity between the two sequences to compare is calculated directly by the program.

By "amplifying the DNA molecules", it is herein referred to generating one or more copies of said DNA molecule, using the DNA molecule as a template.

In the context of the invention, amplifying the DNA molecules is achieved by multiplex polymerase chain reaction assay.

By "multiplex polymerase chain reaction assay", it is herein referred to any assay based on the polymerase chain reaction assay and wherein amplifications of more than two DNA molecules, and comprising more than two distinct primer sets, are simultaneously achieved in the same reaction volume. Such techniques have been long known from the skilled person, who may refer to Chamberlain et al. for further details (*Nucleic Acids Research;* 16 (23): 11141-11156, 1988).

Generally, amplification by polymerase chain reaction requires specific conditions that include a catalyst for amplification or for nucleic acid synthesis, for example a polymerase, a primer at least partially complementary to the nucleic acid to be amplified, and nucleotides, such as deoxyribonucleotide triphosphates (dNTPs) to promote extension of the primer once hybridized to the nucleic acid.

The amplification conditions may require hybridization or annealing of a primer to a nucleic acid, extension of the primer, and a denaturing step in which the extended primer is separated from the nucleic acid sequence undergoing amplification. Typically, but not necessarily, amplification conditions include a plurality of cycles where the steps of annealing, extending and separating are repeated. Typically, the amplification conditions include cations such as Mg++ or Mn++.

It is well known to the person skilled in the art that DNA amplification may yield undesired amplification products due to spurious priming. The method of the invention overcomes this technical issue by adding a step, further to the amplification step, wherein the amplification product is hybridized with at least one set of nucleic acid probes.

This step enables to select the amplification product of interest and to discard amplification spurious amplification products due to. This step thus ensures that said amplification product actually corresponds to the expected product of the amplification of step b). By "expected product of the amplification of step b)", it is herein referred to the polynucleotide which sequence would result from the amplification of a chromosomal rearrangements between the at least two reference chromosomal regions.

By "the product of the amplification of step b)" it is herein referred to polynucleotides that contain: a) a first segment that is complementary to the first strand of the first specific chromosomal region to which a first primer binds, and b) a second segment that is complementary to the second strand of the second specific chromosomal region to which a second primer binds. The junction between the two segments corresponds to the rupture point of a chromosomal rearrangement.

By "probe", it is herein referred to a nucleic acid that is complementary to a nucleotide sequence of interest. In the context of the invention, a probe is a nucleic acid that is complementary to the product of the amplification of step b).

According to the invention, any nucleic probes capable of hybridizing with the product of the amplification of step b), that is to say any nucleic probes complementary to the expected product of the amplification of step b) can be used.

However, the skilled person can specifically design the nucleic acid probes in order to decrease the probability that said nucleic acid probes will hybridize with undesirable amplification artifacts.

For instance, since the amplification of step b) uses primers capable of hybridizing to a nucleic acid strand of one of the said specific chromosomal regions, the expected product of amplification is also capable of hybridizing to the same nucleic acid strand. By selecting nucleic probes capable of hybridizing to the first nucleic acid strand of one of the said reference chromosomal regions, the person skilled in the art ensures that the probes of the invention will not hybridize with undesirable amplification artifacts from non-targeted chromosomal region.

Moreover, since the exact location of the rupture point of a chromosomal rearrangement cannot be predicted, the amplification products will be expected to comprise a new rearrangement of the two specific regions of interest, yet the new junction between those two regions will be difficult to anticipate. If their design does not take this aspect into account, some probes may simply not hybridize with the amplification product, thus decreasing the sensitivity of the method of the invention.

The inventors have found that it is possible to increase the sensitivity of the method by selecting, for the hybridization step, nucleic acid probes that are capable of hybridizing at a close base pair distance from at least one of the primers being used for the amplification step. This technical feature contributes to decrease the probability that the nucleic acid probes of the invention hybridize with spurious amplification products. The base pair distance between nucleic acid probes according to the invention corresponds to the distance the 5' end of a probe and the 3' end of the closest primer capable of hybridizing to the same specific chromosomal region. Preferably, the base pair distance between nucleic acid probes is of between 0 to 30 bases.

In a preferred embodiment of the invention, said set of nucleic acid probes comprises a plurality of nucleic acid probes,
   said probes being capable of hybridizing to a nucleic acid strand of one of the said specific chromosomal regions at sites regularly spaced of less than X/2 base pairs; and
   the 5'end of said probe being capable of hybridizing within 0 to 30 bases from the 3'end of a primer capable of hybridizing to the same specific chromosomal region.

In a preferred embodiment, said probes are designed to hybridize to a specific chromosomal region comprising at least the anaplastic lymphoma kinase gene (ALK) of sequence SEQ ID No.1. In another preferred embodiment, said probes are designed to hybridize to a specific chromosomal region comprising at least the proto-oncogene tyrosine-protein kinase gene ROS1 of sequence SEQ ID No.5.

Preferably, a probe designed to hybridize to a specific chromosomal region comprising at least the anaplastic lymphoma kinase gene (ALK) of sequence SEQ ID No.1 is a probe chosen in the list consisting of probes of sequences SEQ ID No. 273 to 311, whereas a probe designed to hybridize to a specific chromosomal region comprising at least the proto-oncogene tyrosine-protein kinase gene ROS1 of sequence SEQ ID No.5 is a probe chosen in the list consisting of probes of sequences SEQ ID No. 452 to 470.

In an embodiment, the method further comprises a step of detecting the hybridization of step c).

According to the invention, the hybridization step can be performed according to various techniques. The skilled person may use for example surface-based hybridization, wherein the probes are immobilized on a substrate, or solution hybridization, wherein the probes and their targets are both in solution. Immobilized probes are convenient whenever multiplexing is contemplated, as they can facilitate detection of the hybridization. In a first embodiment, the probe is thus immobilized on a substrate prior to hybridization, or on a surface of a substrate. In a specific embodiment, the probe is immobilized on a surface of a planar support. In another embodiment, the probe is in solution. Thus, in a preferred embodiment, the hybridization step is performed in solution. Indeed, it has been shown however that hybridization on a solid surface is less efficient than solution hybridization (Peterson et al. 2002; Peplies et al. 2003).

In order to take full advantage of the hybridization step, the skilled person can further detect this hybridization.

In an embodiment, the method of the invention further comprises a step of detecting the hybridization of step c).

Detecting the hybridization of step c) can be achieved by any technique known of the skilled person. For example, to detect hybridization of the probe to the product of the amplification of step b), the person skilled in the art can tag (or "label") the probe with a molecular marker of either radioactive or fluorescent molecules. Commonly used molecular markers are the radioactive isotope of phosphorus $^{32}P$, which can be incorporated into the phosphodiester bond in the probe DNA, or digoxigenin, which is a non-radioactive, antibody-based marker. Oligonucleotides, such as the product of the amplification of step b), that have moderate to high sequence similarity to the probe are then detected by visualizing the hybridized probe via autoradiography or other imaging techniques. In an embodiment, the probe is tagged with a molecular marker.

In order to increase the sensitivity of the method, the skilled person may decide to use other techniques of detection, such as sequencing or mass spectrometry.

Mass spectrometry is particularly interesting since it distinguishes between polynucleotides that differ in as little as one nucleotide residue. Mass spectrometry can be used to distinguish between two polynucleotides that have the same size, if they have a different composition in nucleotide residues. Mass spectrometry can also differentiate between polynucleotides of different sizes. Thus, preferably, the detection is performed by mass spectrometry.

The method of the invention thus leads to the rapid and easy detection of any chromosomal rearrangement. In addition, it is possible to determine the breakage point for each rearrangement by sequencing. In other words, it is possible for each patient to precisely identify the point where the break occurred. This information is particularly advantageous, since it could help design a specific treatment for each patient. However, the method of the prior art cannot provide clinicians with this information. In particular, RNA-based techniques are useless in this respect.

Thus in a preferred embodiment, the method of the invention comprises a further step of sequencing the polynucleotide molecules resulting from the amplification of step b). It will immediately be clear to the person of skills in the art that the sequencing step is more advantageously performed on the amplicons hybridizing with the probes described hereabove. Thus, in a more preferred embodiment, said further step of sequencing takes place after step c) of the method of the invention. In this specific embodiment, it will be particularly useful to perform the sequencing step with the primer which is closest to the hybridizing probe. As understood herein, the "closest" primer refers to the primer whose 3' end is separated by the fewest number of nucleotides from the 5' end of said probe.

The skilled person may thus use mass spectrometry directly on the amplification products hybridized with the probes. The use of mass spectrometry for the analysis of nucleic acids has been long known from the person skilled in the art, and has been reviewed for example in Crain et al. (*Mass Spectrometry Reviews*, 9, 505-554; 1990). Mass spectrometry method and apparatus appropriate for detecting polynucleotides have been developed by the company Sequenom, some of which have been thoroughly described in patent applications U.S. Pat. No. 7,501,251, WO 1997037041, or U.S. Pat. No. 7,198,893.

In order to increase the confidence of the method of detection, the skilled person can use mass spectrometry after an additional step of elongation of the probes. When the person skilled in the art performs an elongation step after the hybridization step, only probes that are capable of actually hybridizing to an amplification product will be elongated. Probes that have been elongated can easily be differentiated from probes that have not been elongated by mass spectrometry, and this information can further indicate if the amplification product corresponds to the expected amplification product. Hence, the step of elongation of the probes further increases the sensitivity of the method. Preferably, the method further comprises a step of nucleotide elongation prior to detection performed by mass spectrometry.

Many chromosomal rearrangements are correlated with cancers. More particularly, chromosomal rearrangements involving the ALK gene or the ROS1 gene are particularly correlated with NSCLC. Moreover, most cancer diagnosis are performed on biological samples wherein the DNA is fragmented, such as FFPE samples or blood-derived samples. The method for of the invention is particularly advantageous detecting rearrangements in such samples, and can therefore usefully be used for diagnosing cancers.

Another object of the invention is the use of the method for detecting chromosomal rearrangements of the invention for the in vitro diagnostic or subclassification of cancer, for example of NSCLC, in a human subject.

Another object of the invention is an in vitro method for diagnosing cancer, preferably of NSCLC, more preferably that comprise a chromosomal rearrangement involving the gene ALK or the gene ROS1, in a human subject, said method comprising detecting chromosomal rearrangements between at least two reference chromosomal regions in a biological sample of said human subject according to the method of the invention, wherein said specific chromosomal regions comprise at least the anaplastic lymphoma kinase gene (ALK) of sequence SEQ ID No.1 or the proto-oncogene tyrosine-protein kinase gene ROS1 of sequence SEQ ID No.5.

In an embodiment, the in vitro method for diagnosing or subclassification of cancer comprises detecting chromosomal rearrangements between at least two reference chromosomal regions in a biological sample of said human subject with the method of the invention, wherein said specific chromosomal regions comprise at least the anaplastic lymphoma kinase gene (ALK) of sequence SEQ ID No.1 and the echinoderm microtubule-associated protein-like 4 gene (EML4) of sequence SEQ ID No.4.

In another embodiment, the in vitro method for diagnosing cancer comprises detecting chromosomal rearrangements between at least two reference chromosomal regions in a biological sample of said human subject with the method of the invention, wherein said specific chromosomal regions comprise at least the proto-oncogene tyrosine-protein kinase gene ROS1 of sequence SEQ ID No.5 and any one of the CD74 gene (CD74) of sequence SEQ ID No.312, the EZR gene (EZR) of sequence SEQ ID No.313, and the SLC34A2 gene (SLC34A2) of sequence SEQ ID No.314.

The method for diagnosing or subclassification of cancer can further comprise a step wherein cancer is diagnosed in said human subject if a chromosomal rearrangement is detected in said biological sample.

Therefore, in an embodiment, the in vitro method for diagnosing or subclassification of cancer in a human subject comprises:
  a) detecting chromosomal rearrangements between at least two reference chromosomal regions in a biological sample of said human subject according to the method of the invention;
  b) diagnosing cancer in said human subject if a chromosomal rearrangement has been detected in step a).

The invention enables detecting chromosomal rearrangements, in particular chromosomal rearrangements involving the anaplastic lymphoma kinase gene (ALK) or the proto-oncogene tyrosine-protein kinase gene ROS1 of sequence SEQ ID No.5. As such, this method is particularly suited for selecting subjects for clinical tests.

Additionally, the method for detecting chromosomal rearrangements of the invention can be used to select the subjects that are the more likely to benefit from a specific treatment, in particular anti-cancer therapy. As such, it can advantageously be used in determining the prognosis or prediction of a response to a treatment, or be incorporated into methods of treatments.

Therefore, another object of the invention is a method for selecting subjects likely to benefit from a specific treatment:
  a) detecting chromosomal rearrangements between at least two reference chromosomal regions in a biological sample of said human subject according to the method of the invention;
  b) diagnosing cancer in said human subject if a chromosomal rearrangement has been detected in step a);
  c) selecting the subject as likely to benefit from a specific treatment, in particular anti-cancer therapy if a cancer has been diagnosed in step b).

Still another object of the invention is a method for the treatment of cancer in a human subject in need thereof, comprising diagnosing cancer in a human subject with the method of the invention and administering an effective amount of anti-cancer therapy to said subject.

Therefore, in an embodiment, the method for the treatment of cancer in a human subject comprises:
  a) detecting chromosomal rearrangements between at least two reference chromosomal regions in a biological sample of said human subject according to the method of the invention;
  b) diagnosing cancer in said human subject if a chromosomal rearrangement has been detected in step a);
  c) administering an effective amount of anti-cancer therapy to said subject if a cancer has been diagnosed in step b).

According to the invention, the terms "anti-cancer therapy" refers to any type of drug aiming at treating cancer in a human subject. Anti-cancer therapy includes chemotherapeutic drugs and targeted therapy.

According to the invention, chemotherapeutic drugs comprise inter alia alkylating agents, antimetabolites, anthracyclines, plant alkaloids, and topoisomerase inhibitors.

According to the invention, alkylating agents are agents capable of alkylating nucleophilic functional groups under normal conditions present in cells. Alkylating agents comprise cisplatin, carboplatin, oxaliplatin, mechlorethamine, cyclophosphamide, chlorambucil, and ifosfamide.

According to the invention, antimetabolites are agents capable of inhibiting the activity of a metabolite. Such substances are often similar in structure to the metabolite that they interfere with. Antimetabolites comprise 5-flurouracil (5-FU), 2-fluoro-ara-amp (fludarabine), and methotrexate.

According to the invention, anthracyclines are molecules derived from *Streptomyces* bacterium *Streptomyces peucetius* var. *caesius*. Anthracyclines comprise daunorubicin, doxorubicin, epirubicin, idarubicin, valrubicin, and mitoxantrone.

According to the invention, plant alkaloids are alkaloids, that is to say chemical compounds comprising basic nitrogen atoms, which are derived from plants. Plant alkaloids comprise vinblastine, vincristine, vindesine, vinorelbine, paclitaxel (taxol) and docetaxel (taxotere).

According to the invention, topoisomerase inhibitors are molecules capable of inhibiting type I or type II human topoisomerases. Topoisomerase inhibitors comprise topoisomerase type I inhibitors such as for example irinotecan and topotecan and type II inhibitors such as for instance amsacrine, etoposide, etoposide phosphate, and teniposide.

According to the invention, a targeted therapy is a type of therapy that blocks the growth of cancer cells by interfering with specific targeted molecules needed for carcinogenesis and tumor growth, rather than by interfering with all rapidly dividing cells. Targeted therapy comprises small molecules and monoclonal antibodies.

According to the invention, small molecules comprises tyrosine-kinase inhibitors such as imatinib, gefitinib, erlotinib, bortezomib (velcade), tofacitinib, crizotinib, AP26113, LDK378, obatoclax, ABT-263, gossypol, iniparib, olaparib, PI3K inhibitors, apatinib, AN-152, vemurafenib, dabrafenib, LGX818, trametinib, MEK162, PD-0332991, and LEE011.

According to the invention, monoclonal antibodies comprise rituximab, trastuzumab, cetuximab, and bevacizumab.

The invention is particularly adapted for detecting non-small cell lung cancers that comprise a chromosomal rearrangement involving the gene ALK. Those cancers do not respond well to chemotherapeutic drugs or radiation therapy but respond very well to ALK inhibitors. Likewise, the invention enables detecting non-small cell lung cancers that comprise a chromosomal rearrangement involving the gene ROS1, since these cancers are expected to be particularly sensitive to ROS1 inhibitors. It is therefore crucial to be able to provide the appropriate therapy in particular to those subjects that harbor chromosomal rearrangement involving the gene ALK or the gene ROS1.

In an embodiment, the method is for the treatment of non-small cell lung cancers, preferably that comprise a chromosomal rearrangement involving the gene ALK or the gene ROS1, wherein the method comprises diagnosing non-small cell lung cancers that comprise a chromosomal rearrangement involving the gene ALK or the gene ROS1 in a human subject with the method of the invention and administering a therapeutically effective amount of ALK inhibitors and/or ROS1 inhibitors to said subject.

According to the invention, ALK inhibitors are agents capable of inhibiting the anaplastic lymphoma kinase (ALK). ALK inhibitors comprise crizotinib, AP26113, and LDK378. Preferably, the ALK inhibitor of the invention is crizotinib, since crizotinib is also known to be an inhibitor of ROS1.

According to the invention, the terms "a therapeutically effective amount" refer to the minimum concentration or amount of a compound (or of compounds) which is effective to prevent, alleviate, reduce or ameliorate symptoms of disease or prolong the survival of the patient being treated. A therapeutically effective amount is also one in which any toxic or detrimental effects of the agent are outweighed by the therapeutically beneficial effects. More particularly, in reference to the treatment of cancer, a therapeutically effective amount refers to that amount which has the effect of (1)

reducing the size of (or preferably eliminating) the tumor; (2) inhibiting (that is, slowing to some extent, preferably stopping) tumor metastasis; (3) inhibiting to some extent (that is slowing to some extent, preferably stopping) tumor growth; and/or, (4) relieving to some extent (or preferably eliminating) one or more symptoms associated with the cancer.

It is understood that the effective amount will be adapted by the skilled person according to the usual criteria such as for example the age, sex, health, and body weight of the subject.

Other objects of the invention are kits comprising for implementing the methods of the invention, comprising means appropriate for detecting chromosomal rearrangements between at least two specific chromosomal regions in a biological sample of a human subject. More preferably, the kits of the invention comprise means appropriate for detecting chromosomal rearrangements between at least two specific chromosomal regions in a biological sample of a human subject, wherein said specific chromosomal regions comprise at least the anaplastic lymphoma kinase gene (ALK) of sequence SEQ ID No.1 or the proto-oncogene tyrosine-protein kinase gene ROS1 of sequence SEQ ID No.5. Even more preferably, the kits of the invention comprise means appropriate for detecting chromosomal rearrangements between at least two specific chromosomal regions in a biological sample of a human subject, wherein said specific chromosomal regions comprise at least the anaplastic lymphoma kinase gene (ALK) of sequence SEQ ID No.1 and the echinoderm microtubule-associated protein-like 4 gene (EML4) of SEQ ID No.4; alternatively, the kits of the invention comprise means appropriate for detecting chromosomal rearrangements between at least two specific chromosomal regions in a biological sample of a human subject, wherein said specific chromosomal regions comprise at least the proto-oncogene tyrosine-protein kinase gene ROS1 of sequence SEQ ID No.5 and any one of the CD74 gene (CD74) of sequence SEQ ID No.312, the EZR gene (EZR) of sequence SEQ ID No.313, and the SLC34A2 gene (SLC34A2) of sequence SEQ ID No.314.

Means appropriate for detecting chromosomal rearrangements comprise for example primers and probes appropriate for detecting chromosomal rearrangements according to the invention. In an embodiment, the kits of the invention comprise primers or probes capable of hybridizing with the anaplastic lymphoma kinase gene (ALK) of sequence SEQ ID No.1. Preferably, the kits of the invention comprise primers and probes capable of hybridizing with the anaplastic lymphoma kinase gene (ALK) of sequence SEQ ID No.1. Preferably, the kits of the invention further comprise primers or probes capable of hybridizing with the echinoderm microtubule-associated protein-like 4 gene (EML4) of SEQ ID No.4. More preferably, the kits of the invention further comprise primers and probes capable of hybridizing with the echinoderm microtubule-associated protein-like 4 gene (EML4) of SEQ ID No.4.

In another embodiment, the kits of the invention comprise primers or probes capable of hybridizing with the proto-oncogene tyrosine-protein kinase gene ROS1 of sequence SEQ ID No.5. Preferably, the kits of the invention comprise primers and probes capable of hybridizing with the proto-oncogene tyrosine-protein kinase gene ROS1 of sequence SEQ ID No.5. Preferably, the kits of the invention further comprise primers or probes capable of hybridizing with at least one of the CD74 gene (CD74) of sequence SEQ ID No.312, the EZR gene (EZR) of sequence SEQ ID No.313, and the SLC34A2 gene (SLC34A2) of sequence SEQ ID No.314. More preferably, the kits of the invention further comprise primers and probes capable of hybridizing with at least one of the CD74 gene (CD74) of sequence SEQ ID No.312, the EZR gene (EZR) of sequence SEQ ID No.313, and the SLC34A2 gene (SLC34A2) of sequence SEQ ID No.314.

The following examples are given by way of illustration only and are not, unless otherwise stated, intended to be limiting.

EXAMPLE

Example 1

The ALK/EML4 chromosomal rearrangement was detected as described herebelow.

1. A first round of PCR was performed, in order to amplify the DNA comprising the chromosome rearrangement.

A first premix PCR was prepared using the reagents from the kit 10x96 iPlex Pro Set Genotyping reagents (Sequenom).

For each PCR condition, 2 µl of the PCR mix were prepared in the following proportions:

| Product | Volume |
| --- | --- |
| H2O | 0.8 µl |
| 10X PCR Buffer | 0.5 µl |
| MgCl2 25 mM | 0.4 µl |
| dNTPs 25 mM | 0.1 µl |
| Sequenom PCR enzyme 5 U/µl | 0.2 µl |

The 2 µl of premix was added into four tubes. In each tube, 1 µl of a specific mix of primers (either mix A, mix B, mix C or mix D) was added.

Each mix of primers comprises a set of 38 primers hybridizing with ALK ("forward primers") and a maximum of 40 primers hybridizing with EML4 ("reverse primers").

2 µl of DNA (at a concentration of about 10 ng/µl) from the biological sample of a subject was then added to each tube.

The PCR was performed under the following conditions
1. 94° C. for 2 min;
2. Then 45 cycles of:
　94° C. for 30 sec
　56° C. for 30 sec
　72° C. for 1 min
3. Then, 72° C. for 5 min,
4. Finally, 4° C. until further analysis 2. The product of the PCR is then treated with SAP (Shrimp Alkaline Phosphatase)

2 µl of SAP mix was prepared for each PCR described above, according to the following proportions:

| Product | Volume |
| --- | --- |
| H2O | 1.53 µl |
| SAP 10X Buffer | 0.17 µl |
| SAP enzyme | 1.7 U/µl |

The 2 µl of mix were added to each PCR volume.

The following cycle was completed: 37° C. for 40 min, 85° C. for 5 min, and finally 4° C. until further analysis.

3. The amplification products of each PCR were hybridized with probes which sequence is adjacent to the 38 primers hybridizing with ALK. A second PCR was performed, to obtain an extension of the probes that have actually hybridized with the amplification products.

The mix of probes comprises the probes of sequence SEQ ID No. 273 to 311.

2 µl of a second premix PCR mix was prepared for each PCR described above, in the following proportions:

| Product | Volume |
|---|---|
| H2O | 0.755 µl |
| iPlex Pro Buffer 10X | 0.2 µl |
| iPlex Pro Term Mix 10X | 0.2 µl |
| iPlex Pro enzyme 33 U/µl | 0.041 µl |
| Probe Mix | 0.804 µl |

The 2 µl of mix were added to each of the previously described PCR volume.

The PCR was performed under the following conditions 5. 94° C. for 30 sec;
6. Then 40 cycles of:
   94° C. for 5 sec, followed by 5 sub-cycles of
      52° C. for 5 sec
      80° C. for 5 sec
7. Then, 72° C. for 3 min,
8. Finally, 4° C. until further analysis The content of each PCR tube is then transferred on chips for mass spectrometry reading on Sequenom's MassARRAY® Analyzer 4. This transfer is carried out using the Sequenom's MassARRAY® Nanodispenser.

Example 2

The same experiment as in example 1 was performed for detecting ROS1/CD74, ROS1/EZR and ROS1/SLC34A2 variants. The primers used were the primers of sequence of sequences SEQ ID No. 315 to 328 and SEQ ID No. 433 to 451 for the ROS1/CD74 variant, SEQ ID No. 329 to 336 and SEQ ID No. 433 to 451 for the ROS1/EZR variant, and SEQ ID No. 337 to 432 for the ROS1/SLC34A2 variant. The amplification conditions were the same as in example 1.

A ROS1/SLC34A2 rearrangement was successfully detected using probes specific for this variant (SE QID No. 471-487) whereas the two other variants gave no signal with the same probes. In addition, about 30 DNA which were classified as negative (no translocation including ROS1) by FISH were confirmed to be negative with each of the 3 variants.

Example 3

Sequencing was performed on the ROS1/SLC34A2 DNA of example 2, either after the first step of amplification, or after the detection step. The primer used was SLC34A2-7 (SEQ ID NO. 343), the closest to the probe SLC34A2-7 SEQ ID No. 477) which gave the strongest hybridization signal in the experiment of example 2.

For sequencing purposes, 10 µL of the amplification reaction were first purified "QIAquick PCR purification kit" (Qiagen). The sequencing reaction was then performed using the BigDye Terminator Kit (1.1 or 3.1) of Applied Biosystems, and the products were analyzed with the ABI3130xl sequencer of Applied Biosystems. The same sequence of the breakage point was obtained and is displayed in SEQ ID No. 494.

The inventors were equally capable of obtaining the sequence of the breaking point when using a primer (SLC34A2-6: SEQ ID NO. 342) farther from the positive probe, although the intensity of the sequencing signal was lower as expected.

Example 4

In order to assess the effect of the positioning of the probe in respect to the amplification primers, the following experiment was performed.

When the DNA is of good quality, a smaller distance between the probe and the primer is expected to lead to higher sensitivity. This is even more important when the DNA is fragmented, since the size of the potential amplicons is already small. Thus, in this case, only a probe close enough to the primer will be capable of hybridizing with the amplification product.

This was experimentally demonstrated on DNA isolated from a cell line positive for the translocation ROS1/SLC34A2. A negative control with respect to the translocation was used. The primers/probes used were either close (group 1) or remote (group 2). The same primers were used, but the probes of group 2 (SEQ ID No. 488 to 493) were shifted by at least 60-bp with respect to the probes of group 1 (SEQ ID No. 472 to 478).

Results are shown in Table 1.

TABLE 1 the results are compared between a positive sample and a negative control with a set of probes close to the amplification primers (group 1) and a set of probes further away from said primers (group 2). The results are expressed as units of signal intensity (positive above 0.15).

| | Group 1 probes | | Group 2 probes | |
|---|---|---|---|---|
| | Positive sample | Negative control | Positive sample | Negative control |
| Probe 2 | 0.08 | 0.02 | 0.09 | 0.09 |
| Probe 3 | 0.47 | 0.01 | 0.27 | 0.01 |
| Probe 5 | 1.92 | 0.03 | 1.38 | 0.00 |
| Probe 6 | 3.12 | 0.11 | 3.24 | 0.00 |
| Probe 7 | 5.25 | 0.00 | 0.09 | 0.01 |
| Probe 8 | 0.00 | 0.01 | 0.02 | 0.06 |

With the probes of group 1, a positive result is observed with 4 consecutive probes (4, 5, 6 and 7), whereas the more distant probes of group 2, only 3 consecutive probes are positive (4, 5 and 6). Probe 7 which yields the stronger signal with the probes of group 1 is thus no longer detectable when the probes are too far away from the primers. Decreasing the distance between the primers and the probes is thus crucial for improving significantly the sensitivity of the method.

SEQUENCE LISTING (494 sequences)

SEQ ID NO: 1 - DNA, 728838 bp, Homo sapiens
  misc_feature: ALK
agctgcaagtggcgggcgcccaggcagatgcgatccagcggctctgggggcggcagcggtggtagcagctggtacctcccgccgcctctgttcggagggtcgcggggcaccgaggtgctttccggccgccctctggtcggccacccaaagccgcgggcgctgatgatgggtgaggagggggcggcaagatttcgggcgcccctgccctgaacgccctcagctgctgccgccggggccgctccagtgcctgcgaactctgaggagccgaggcgccggtgagagcaaggacgctgcaaacttgcgcagcgcgggggctgggattcacgcccagaagttcagcaggcagacagtccgaagccttcccgcagcggagagatagcttgagggtgcgcaagacggcagcctccgccctcggttcccgcccagaccgggcagaagagcttggaggagccaaaaggaacgcaaaaggcggccaggacagcgtgcagcagctgggagccgccgttctcagccttaaaagttgcagagattggaggctgccccgagaggggacagaccccagctccgactgcggggggcaggagaggacggtacccaactgccacctcccttcaaccatagtagttcctctgtaccgagcgcagcgagctacagacgggggcgcggcactcggcgcggagagcgggaggctcaaggtcccagccagtgagcccagtgtgcttgagtgtctctggactcgcccctgagcttccaggtctgtttcatttagactcctgctcgcctccgtgcagttgggggaaagcaagagacttgcgcgcacgcacagtcctctggagatcaggtggaaggagccgctgggtaccaaggactgttcagagcctcttcccatctcggggagagcgaagggtgaggctgggcccggagagcagtgtaaacggcctcctccggcgggatgggagccatcgggctcctgtggctcctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtgagcagctcccgcctgagtgtgccgggatttagtgtttttagtcacattgatatgcaaccattaaataatcttcacttccaccccactttctaaaacctcagctctgcttcatcgccctccttcctcccgcaaacctccttcccgaatcagaccgtagtttcttgttttctccctgaacgcagttcaggggtcttccttcctctttagcaaccaagttgggggaaaagtttcatactcttggcagagcgccttcttctctggacttatacgctgtccgagacaaaattgggcgcccctcttcctgggccccgggacagttgaaatgccccgattacttccaggttccaagcttagtagtagatgtcaaaactattgcccttctctccctcttgttcctggccagcacagatttgggaaatatggtaccttctcagggaatatagaatttctcttcatattattgaatctcacccaactgtccccattccaaacgttggcttgggcaggtattgccagggattgtctcttctttatttatttattctccccctcccacccccacccagtctgctatgcactctcgactcatcctttctcttacatgttgttgggaaagccccagagaaactaaggaacagaggacaggagggaggtgtggaggaaggaaggaaagttgtcaagattgtcttcctttggggagtcactatgaagccagggagaaaccatcgttggttttcctgcttttcttacctttccccactcctcctttcccctctgattcttagcttgaacgtctgcagcagcagctcttgatgatagtctctggcagcttgtttcactgcagatctccctgctggagactcctaaaatgagatttttctgtttcatttactccctcatttcttgccatattcactgagttgggggtgtgtgtgtgtgcaggcacttacttctaactctttccagagtatcctttgactggaaaaccaggtggttttgaatcgatgttcttcttgtaagacaactggggaagacttgtgaataaaatatacaatgtaaatgaataagaaaggcacagaaaagaaatcaggcttttaaaaagcctacacaaattccatcaagcaaacccagcttcttttctatcattctcatcatcagaaataaatgaagttcttatgctccactggctactaatgtctaatattaattggatggaaaccattgaaaagggcccattgtagagctacaagtatcttgcatgcttgtgcacacacatacacacacacacgagtactctcatgcaggagggatattcagaagctgaggttccctagtcattgcacagaatacatactagtatgtgacccccaagaaaaacagagtgcggatgcacatttcaacattagtgttagtgacactggcacctaaagtgagcccttttcatttagtgctggaatttatatagaccatcctaagaggcactgatgagtttgatagtgccttcagtgaactgagatggaagactgatactgttgttccacccaagatgtttttgtaaagaacagctgggctttaatgtcattgtggtttgtgtggtttatacatgcaacattctgttttagtgcccagtgttttagtaatggatataaaaatgacttctctggaaatgcagattatcttctagtttcatgcctctgagcatctgtggagcttccccatcaccttttatcaaatgaccatagaatccagcagtctgtatcagctgttgtcagatgttggtgacaggcaaaagggctcatttctacagccccgaacctgccaactgtaaacaggtaggttgcatgaagctatcagtgggtgtctctgaagagtcacatgcttaattcatttaaagaatatactccactcaagtcttaaataaggtgttggagctgctgagtggggaggtttatgtagaaaggctgtgctccaagggcttctctgctattggctgtagggaagcattgtgggcatcccaagccctccctcagtggcccagtacatttggcagctggaccaagcccttatgcatcatttgacacatctagcaatgctgatttcagtaggagccaggattctgccattaaaaggcaagaaaatttggccaagcatttttcagcaggattggaatcaaatgattattgataggatcaaataagacactaagtgtaactggatgagctccccatgacctccagagagacagccagcctattgaaaagcacttcgggccttgtggtgatcatacttggaacagcctggtctctcctttctctgaggacatatgctgtctgcagttaggcagctggccatgcaggactagcctctctcacattatcattgcctccccagcctcattcagatacagtctccattgcagacatccccatggagtagatacaccttgctataccatgttctgtgtttcagacaacatgtatcattatggttccgttcattttccctatgaaaattcaaggttaggttctgacactgggattgattttgctatttatcatgtttggagaaatgggtttattatttttatataggctctgatttatagaaaaggcatttaactcttctatgatgtgggctcttcaattatacagaaggaaagtaggcacagctcagcttattttcttcctgtgtctgcccaagtgtcttgtctggaggtacacaatgatgctgatggggctatttgtgggggagggaagagctgattgttcttccatgttttgtggtgaggggcctggagcagcccatttggctcagaccaaagatagcttcctaaacctgagcaggaccatgactaaaatagtaaaaatgaaaaagcaccagttaggagaaagcaaaaccgttgcattgcttgtgatttgggctgtctgagaggacagaaagatgtctgagaggccttataatgcatgaaatgctaatggtttttccttgtgggttactgtgaattcagaaataggatcggcatttcaagtctgaggcagatcccaaattcacccattcatggagaagaggtgaagaggcagtttctgggactgtattaatggttctggcctctcccaggacagcccaaatcatagaaaagatgtctgtctgcaaggctggcatgttgcccacagctccagtttgtatcctggcttacaggtgttttgagatctgtttctgctgtcacccaggcagagggctaggggatgatgactcatgggataggaggcctatttccctgtaagcactccctccccacccaggaaagtggatacatgactttggattttacatgtactatggagaggcctgagcaatttagagatgtatgcaatgcaatatatctgacctttgaactcccatatctgtcagtcccttcccatttcatttctggagtgggcagagagagcaaaggaggatggagaggaaattggagctcccagaagggatatcagttattggaggtgaattgggagaattggaactagtccagagaagagcagagagctgatttaacagttgaagggactgatttacaatgaaagatgaaaagaattaaatatatatggctgggctaaatggcgatgaagggaaagccatggtaacaatctacaaatctctgaagagagagagtggcagtgaaggagaggagttatttagcgtggcccatggaagtaattggatcatacttgtagaagcaaacttcgggttggatatcagggaaaccttgttttctgacattgatattcctctgactatggaatggaattccaatggagtggggagtcaggtgagatgtgggtcagacaagtcccagcattcctaattaatcagttctatattttcacatattgagaagctacaacaggacagagagctgggatgcagaatggcagaaggaatcagaacctttttatgatccaaaccctggagcctttgggcattggtgtttttagaggaaaagaaaagaattgcatatacatctttgaagttggtgagaagcacttaagaaattgttaatgacaaatattttgaaattactgaatttattcttccctgccctccaattaaacatagattatttctctggggtgcgatctgtatatccaggggtttgggaggcacaatcaccagagaattgtgtatctaagatacatctatgggtgagggtatatgacaaagcatcactgagcagggcaaaaggtgacctgtgtcttgagaagatgccatcagttctagatttggtggactcctactggctacttaaaaatccctttaaatgttgagaatctatattgccatttgaaagatgaagttcatccacatccaatttaacatttcaaaaatttttaaaagagaaagaaggtccatgaggggtttttgtgtaaggcatgggaggagagtgtgattattaataaaaatgggtatctaggctggccgcagtggctcatgcctgtaatcccagcattttgggaggccgaggagggcagatcacttgaggtcaggagttcgagatcagcctggccaacatggtgaaaccctgtctctactaaaaataaaaaaattagccaggcattgtggcatgcgccttagttccagctactcaggagagttgcttgaacctgggagttggaggtttcagtgagctgagattgtgccacctcacttcagcctgggcaacagagtgagaaaggaatatctataaggaagttggtctgctgaaaatcaggaggaactggcctgaaggtgggagaagaaaagaatgagagttgatcagcagaagtctcagtgccctgccactcaggatcactgcctggcaacctcacaacatggaaatttttccagtctgacctgtaaaggaaattttgcctttctttataatcattattagtgtcctgttatggttatttggaactttacaatttataaagcatgttcacatttattattacttattaatcctatggtaggcaggacaaatgtttgctttattttgtaaatgaagtaactggaatccagaccatatttttccaggtcatatagcacaaaatggtatacacctggaaactttcatactgactagaaccacagttcccctttccttcaagtcagagttctttccactaagggaatcatctccaagtgcagattacaaagagcaagacatgtcaataggtgaaaaaatttccagtatccttgctagaagaccatgcaacaaatatttggtgggcaatagccagggcttggaaaaattccttgaaatcattgaggcccagctttatcattagaaaaatagggatataatagttcttaaatgttcctaaatggggatagtaatagttcaaggtgttgtcatgaggattaaattagatgatgtgtgcaaatccttaacccaatgcctgatgcaaaataaagtgcttcatcaatatgaaccactattgtttttttatataatagcaacagctgcactccagcatctggtcatgcaggctgtgcactctgcaactctaggggttccatatacattttagtctgtctgaatggtgccatctggagttgtaatctctatgtgtggccatgtgtggcaatcttggcagcagcagttgtgatgctgttgttctccattcaactagcttcttacccctaagagatgaaaggtgggatgtatgggaaatgaagagagttataagtgtagtagtttctaccatttcaccatggaaggcgactttctcagaaatatgcatggaaaggaggattgaagtgtggtatttacttcctccccatgaattaatgtcctctcgtaagccttttgactttggattcagttcaaagagtccaccagcatattcgcaatccagttcttttttcctacagaaggaaaccaaggcttaactttatgaaaatatgaaagttaagatggaggaagaacaagatagagatgttacagcggaatcattttcagatggcagacgtttcttaactgagagtgctctgtccaggtctagaggcactgggctactggcctctggtaactcttttattttaattagctgaagatgtgttctttctgtattttcagcatcacccttcattgccaagtggagaatatggagagaaatgtaaattaccaactggttaatggacctgagcacattaagagcagttaaactttgagactccctggagacgtataacccagggacttgagtgggaggctgcctcaggaagatccctcaatctaaaaaaagaggctaagaaccacagaacattttgtacatggtggtttctatgaaccatagctgagccattgcctccaaaagatgcacatgaacatcatttctacttgggagtagataaaaaataaggcgtgtgggtgaggatggttgtaggtctaggatcatgtggagagagctgagaataaagctatcaaggagtccttcttctttacagccattgtgttgctctgtggtctagggtgtggccaatgtttcttaaccttgtgatgaccagggctctttcacacaggtcaagatgtaagcagggagtgttggcctggtggtgaggtagtggaggaggttggaggcattcttcagtatgctttttgattaattgtatttttcagaatagcttatttttcttcagtaaattttgtgatgaatttttcagctggctgttctgagcttgggtcctttcccagggaaattctatcagattcgctttgtgttgtggtgtacatattccagaaagtgggcagagaagatctcccttggggaagatacacccaatcccttggttatttaagagtcttttttttttcttgcaccttacctttctgactaacaacaggtgcatgcagtggtaggcagtcagaaatccttagagtaagaataaagctaaaggaaggtatgaaaaaggtatgaagttagaggacaagggaaatctaggcaggcttaaagaaatcaggaaactagccaaaggaaatgaggatagattgaaccattggttatatttttctttgacccctacttatcttttatttagttttcattggaatgtgagttcatgagggtgagcatggaaaggactcttttaagcccagataagtaaagtaagtgttctgtggtgaggagaacactagattaggagctcgaagacatgaattctatgatgttctttatcttttgttagctttgcaatcttctacaactctcttaaacttgctaagcctgtatatttatatatgtattataaataaaatatatatatatgccagtcatgcgtgttttaaataacttttaaatagaaaaatagtcctttatagctatccagatatataccatttcttttgctcttcccttttcctcaagtttcaatatttcctattttattatttcccttcagcctaaagaggtctttttttgcatttccattagaataagactattgacgataaattctcttagttcctgaaggatatttttactaggttcagaattatgcattgacagttcctttctttccacactttaactattttgttcctgtgtccttcatagtttgtgatgagcaatctgccattacattgttgttcctttttgtaattgctttcaatatttttttcttggcttttggttttcagaatttgattatgatgtatctctgcatggttttatttgactttatcctgtttgtagttttttgagactcttgagtctataagtttatgtctttcatcaaatgggatttttcaattattattttctcctttttttcctgcaccaatatattcctctcctgagactctgattacacacctgttagatctcccatgctcttgagacgctgctaatttctttttttgaaatttttctctttgttctgtagattgaacaatttctattgacctatcctcaagttgattgactctttcctctgttatctccattctgatataattatttactttagatattttagtttccagtttaaatgtttcatatttgacaatgacttctgtttcttgatgagaactacctttccattcattttccagagtgtttactttcaccttatgggacatggtcataacagcttctttcacgtctttgataattccaacatctggatgatcttattattggcatatgatatctttcctcttaagaattagtcattttttttcttttatgttgagtaatttgagattgtatcctgcaaattttgtacattacattgtttggtctgagttgggtgtggtttgaacctttgctttgttctcaaagcctttgttattctgctttgagtctgtccacacctctgccactcaggtgagctgaggcccttggccagttccgtcagcgaattagcatatttccttctccagctctctttaggattctccttaaacttagagttttacctacctgtattattgctgcacagatcctgcatttagggttgcccttgagagatgacagcagagagatgataaagcagatgaaagtagagagatgataaagagaaacaaaatggggattccctccataccctttggactgaagggacccctttcccagtcctttatcctgaaagttgtggtttctaccagggtttctatttgagggtttctatcagcagctatgctggctctactgaagggtcaccatcatgagataagaaggaaaaaacaagtaaatgtagattttcctctgcactcactgaatcataaagttcctttccctgtcctttgggtgagaaagaaaagattgctttgggccccttagctgtccatggtgctaccaccacagattttctgggtgcctgcattcagttcacagacaaaagaggtaaaaacagaagacttgccttcatatgaattgcttttttcaggttttgactctcttcctcaatgttcctgattttacttttcagagtccccagtagtcattttttgtttttcttgttgttgttgttgttgttgtttcgtccagagtatttcggttgtaaagaacaggatgaacaggactttgtgggcttatttcatcttggctgcacttggagtttctcatttctatgttgaatcagagtttccatctgtaattttttcctttagcctttaatatttaatgttgtgctattctgtatttaaattatctcagcttttgtttgctgaaagtgactttattttgctttcatttcagaaaaagattttcactgggtatactttcaggtggatagcactttaatgctgttgctccattgttacatggtttgcattatttccagtgagtcagagaatttcctgagtcagagatgctctttacctgtttcctgttatgtctttcccaccttctgccttccttaggattttctttttatcataggattttagaaatttgattaatgatgtgcccttatgtaatttgctttgtgtttttcctcctagcaatttgttgatagactcttggttctctttatatttttcatcacatttggaaatttttaaaaaaattgttttctgctcctcctttctaagaattcaattacaattgtgctatacttttatggttcccgtactttattaagggtctgttcattttttttctcagccccttttctctctgtatttcagtctgcatagtttttattgcatattttgaagttcaccctcttttcttctatagtgtctaatgtgctaataaaccagcccatgtaataagttttcactttagatactgtattgattttcagctctagaatttctgcttccatttttatttctatcttcattatgtttatgtctttctctaagtccttgaacacgtataacagctattttaaagttcctttccactaattatagtatttctatcatttctatgtctacttatattgatcagtttttctcttggaaataggtcacattttcctgcttctttgcataccttgcagttgtttttttttttttttttggtgtggtgcattatgaatattccattgctgaatgtgtggacatttttgtcttcattgaaagacttttgaattttctttgacagttaattgacttgtccatcaattttatactttcaaggattattgtcaagctttgtttgagggagtttagagaagtctttattctatggttagtttaagcctcctcttaaggtttggcctttctggagtctccatcacatgcctcgggtattcaaaggtattcaatgaggtctctcctctctggttcttacacacttaaaaaacatttcccaattccatgtatgagctgtagaaattgtttggcttacagttccctgatagctattctttacttggtagctgctctttgcttagtcttgtggaatctcactgtatgaatgcacaacttaatatttagccaaagactcaagaggacttctaggcagttttgtggagcattctctctctctctctctctctctctctctctctctctctgtctgtctgtctctctctgtgtgtgtatgtgtgtctagttgtgccttctctggtttgctccctggaaattcgagctgcttcagcctttctagacaccaatctctatgacctcaagtcactgaggccactatgctctttttggccttctctttcctgtgtcagagtctggtaaatgcctctaggcaaaaaatcagaacagtgctagggcccaccacatacattctcactctttcaaggattatagtcctgtgttgctgattattccacagtttctttcaaatattttgtcagttttacagttattcatggtaggaaggatcatgcagtgctagttcttgtatcatggccaggagcctatatgataagctttgggatctaggtcatactagcttgtctcctgagataccatatagatctccatgggaggtgcgcaccaaagagaaattagacaagggaatccttttaatggagatctataagtttgaatttttgcctgaggaaatgcttatttattggtttagtttttttttcttttaaattgagcacttgccaagttgaatgaagtacagtctcttcctcccaggagttcacaaactagttggaggagaaaaggcagacaaagtatgctaataaataactccaataaaaggcagcacttgaatgctaaacaaatggtgcagctggttatagtagttggatagagggttggagaggtcaattcctgctggggtgattaaggagagtttcatgctgtacctccaaatctcaaaagcattcccttaaaggcagatgagcagtagttttcagtgcattatgggagaggtaaagtttctctgagacaggaaactatagctctggaattttagaaacaataagcttattgccttttggcagggagtcaggtcaaaggatatctgctgagaatgatggtttccttttgagactgagatagaagtgagtaaaaaataaaaacacttccagaaggaggtaatttgagaatagggtcttggagagagtgcagctttttacttcaaaagagaaggacaaaggatcttctgagttggggcaagagccaaaataatgcccagatgaagaacaattggctagagaaagggagagaggaaagagaagagaaaggagagacagagagacagaaaggcagatagacaatgtgtgtgtgtgtgtgtgtgtgtgtgtgtgctctggagagtagaaccagccagagcagagagctctaaggtgctaggtcagatattctgaactagaggttagcctggctttttgtgtctggaattttgatttgatgctagagaaatctgaacctatttaggtcttgagtaggggagatgcattttgactgcgtgttgactgcagattattcaggaaatgtattttagtgtgggtctcaggcctggatgtagagagggctagtgttggagccccgtgaagctattacaccaaataagcaatgaaagagtcagagctgggccaatagatgcccagatataagaggaacaaatgagaaggagtcaaaagtctaaggttttggaaccttgaagacttatggtttactgataaagaagacagttgggaagaggatctggtttgaggggcaagtggttggcatgacaataattctagtgtggcatccatccaaagatgagggtatctgggatgcacatgaaagcatgggcctgaagcaggaatggggaagaggtcaaggctgaagatatcgatgtgggagctatttacatgcacgtggtaatttaatccttgaaaaaaagagatgagttttccagaggacgtagagagaggaaagaaggaaggtcacagcttagatttaggaaagttcataattagacagtagaatggagtcaatgacatcaccagaaagaattttcttacaagaaggaacagaggcctctgtggatcatgtggtgttatagaagctcagcaaggcagatggagtggagagaccattgtgttggaccaagagcaattcacggagtgtcttgtacagagcaggaacaggcagaaggaagtttagagagagtgctgaagaaatagaagcaaaacgtgtttaagtagtcatttaagaagtctttgaaagaaagaagagaaagagaatgaaatatcagtgatgtcagagggttcagcagcatggaggaaacatgttttatgatagcaaacctcttaatgttgaaaatcaggagggaaaaagctaaagagaaaagatttcaggtatctgaaagagagaggataattgtatagcaaaaccattcaatctaggtgcagactcttatacaggacttagatgccgttatatctagggccctgtctgcttctggagtttcctcttaaaatagagttcattcaatcttatttaaaaaaatatttctgctactcgggaggctgaggcaggagaatggcgtgaacctgggaggcggagcttgcagtgagctgagattgcgccactgcactccagcatgggcgacagagcaagattctgtctcaaaaaaaaaaaaaaaaaaaaaaaaaaaaaaccttaaatgtatatgtatatttctggggatgtggggatcactattttccaaggcttccctgttacctgttggacaagtctgttgggaaaatatttaatagtggtcaaattctattcctctgtaatttaatgataacagctaccattgaacagtttgacatagactgctttatttagtcctcactataatgtggtagttttatgattttagtactcttttcgtttttgcaaataaagaaactgatgctcagagaggtcagataacacgatccaggttgcacagccagtaagtgaaggatctggtatttgaatttcagcctgtttaactccacatctatgatctctctgtcttatgtcttttacttgtgactgtagtttggctgacaagtattaacttctccccaacatgagggtccttcaaacatttgaagtcagttatcccacatatcctatatatttttctttgtctcctccttcttttcattctcctcctctttctctcctatcccttttctttaaaaaatcattaattcaacaaataattattgggcagcttcagtatgttagacactgtactagatgctgcacagacagcaatgaacaaaacagacatgggctttgcccgcatgggatttatagaatggtgagggaagaatattaaatgtgcaaatgaacaaataaatatataatgagaaatgatgatacatgctgggaaggaaacaaacgtctctagcccccttgtcacttttcctcattcaccacaggtttcacagtgctcactgagcctgcttcttcccccctgccccacacgccctctcctcttaaagcatggccccagatgaggacaacattctgctcctgtgatctgaccctctatagcgaggcccttgaactgggaaacctgtgttgttgcagtttagcggtaggcatgggcagaactgcaggcaggggtacaatagagaaggaaaacaacctccttctctgagatgagaagacaaatgtatccaaggccatgcagagatgaaaggcagagagcccaggagtggggccagacagcggtctcaatctgttctgtgaagtatgagcaaaggttgtgctaaacagatcacaaagccatgcatccccttccattcctcgcatcctgcctttcccttcatgctccagcccccttggacccacacatctgcttgacaaatgcagccaagggggaaagcacaaaatttactaaatagaatgcttcactgtggctggctaggtaggaaaagggattccttctctgtctccctccttccctccctctctccctcccttccttccttccttcctcccttccttctttccttccttctttccttgccccttcccttccctttccctttccttttccctttccctccttctcttccttccctcttaccttctttctttcatagtattaatcttgacaccataatttggaagaatctgattggagaaaaatgtcatgaagcacaaatgcagatttgatatatctgacctttcttctcttcagaacaataaatgtcaaatagcttaaaatgacagcctggataaccagagattatttatgtgcttaaatatttaggcaagaaacatagtttagacttaagtctaatttacatgaacatgctgacctatgtgaatcagaagcactttaagggatccatcacaagcagtggtgtttgcatttcagaaaacagaaaatgtgaaaaatcagaatagagtagaagtggtaaatgacccttgataagtaatgagaatgtttgataacatcaagaaattactttgcagcacaaaattgtgtttgcatttttcatatctgagtggtgtggtggcatctggagaaggacccacaacccacatgtcctctcctttatcagatgcaaagtattttatatgtgcatgtgtatgtgtatcatttattcccattttactgaagacatttactgttaaaacagaaggagggagaattatcttgcttcagctctgtaaatcctgatagaagtgtaatcccccagacagagtgtaattctctactcaacctcacactcaattatcatcaggaacaggctcagaaaggtgggtttcttgttttgttttgtttaaagaactctgaacattcgttaacccctgtacttctgaaaggagaggatattacattgtgttaaggaagcagaatctggaattagttctaggtttgacacccagctccagacattcttaagctaatatgaaaatagtttttctggtcttagcatccttatctgtaaaattatagtacttgctttatagggttcttttgaggagtaaatgaggtaaattttaagaagagtttagtgtagcatctgtgacatggttagagcactgaagatattatccattatcttctgttttattattattgatgttgttattaataaaggggtttcccctcattattttttgtggcttcctttctatctcatttttgctgagatctaactattctcacagttagagtttatcttgtggaaaatataactaaataaatgagggtcacaatataattctttagatattgagcactggagcagctgttttgctctaagagtgaaagttaccagaaaaccaatcctgtcccattatgcattgcctaaggattccatattgaaccagcgaatcttttgtttatttatttattcatgttgaaggattttaattaaatcataaataatatttccaaagtcaggatattcattgtaagatcttttaatttcacagcagaaaaaaaccctatttcaataactaactaggaaaatttaaaaactgtaatgtgagttgaagcagtggaaagagggaagagagttctcgaccaggagttgtgagattaggttttcattttagaatataccaagttattcttttttaatctgggcaaatcacctaaacttcctgagtctttgtttctgtaatatcaaataagtgagttctaatctctgtccttttcatattaaaatcctatgattctaacctatttcctgggctgatgctgaagcatgactgggaaggtgttatttctataaacagttgcagggtccgttagaatttcataaagcagtaataagaaatcatcaccttctctgattcttatgtaattggtaaattatgataagagctgcttacctctaatatgctttaaagaccatgactagattaagaacatttatttttctttctaccccaaaggaaaacccaaattattttgatgcttttctggatatatagtaaactcaccagagctgctttgttatggttttctgttccaatcattatagccaattgtgtgaacagaggcaatcaatcaattgattgatagaccaactgataaataaatatctacctacttacatacatacataaaaactattttctcttccttatttgggtagggtttatgttagggttgggactgagggacaagggagtgtttgactcatctgtctcagatgagggacgtagtaggcgctcagtaaatatttgctgaatcagtgaaggaagaaaaaaggaatgaatgagggatataaatgtggtatattaaaaggactatctgagcaagttctttctatctttcatagcccatgtcccagtgaatacagcttgtgtttatacattcacttgcccaattcttaatggttcactgactttttccttaattccaattcttcattctacaaatagtccctgagactttccatgcgttcaggactttgtacggttctatagggtaacaggcaataattacaagatgtagtccctgactttaaagacttaaagtctaatgaggtaaacaaaaaatataggattttgagtcagcatttggggattcaagacttgacaccatcatcagttagtttcatgatcttcatttaaactctctgggtcctagttaagtgcagggatgataccaaccccaccaggttgaggggatcagataagattatatgcataggttagtgcactgtaaaatcaaaagcactgtgagcattatactacatactttaaaataatactagatggtgtgagcttaagagctaaatgtcttcgggcaaagaacagtgagtaggattggtgagtacaggcttcctgatggagctgaagcttgatgggttttggaggagtagggtttggaatagtcaggatgaaagaggaatagcattccaggtggggaccacagagtatggagcacaaggtcagtccagtttgtcttcctgtagtgcctaaaatgagcctcatgctctactgggccctctcagtttggagaagagattttatgtcggtaagtacagttggatgggcaggatggggccaggaccttggagagcaagcagagggtgtttgactttcttgcagcaggaaacaggcagccatcaaaggcctgatgtaaatagcattttaggaagatgaaactggcaatggtgtgtggtctggattagcatgtagggactggggtcaggaatctggggtggaggagagggaagatttggaaagatgcagattcagcaggatgatggagaagaggatggcttcagaaaaacttcacaggccttggcacaaggggccgaaaaagagaaattcaagctttctagcactttttgccagcaagattagaataataatgggtcatttgatagaaaagaatttgggaagaaaaaacattggggaggaagagttgagttcaatttgcacctggggagccgagatgatagcccaactccaagcagctgtgtcctgctagctggaaacatggcactagaactcatgtaagaagtcagggctgggcatggggatttgggagtcatcagcacagagacttctcataaattatgtgctttgcttagaacttaatttcatgtctttttggaagataagagaaatgaaaagcttgctgaattatggattatgcaactgtattcaaagtaattctctctttccccctcccctctgcttccctgatgaattttgtgttctgttcttcctgttgatccacaccccctacccctaattctttgtaaactgaggaacacaataaactatttctttcagatcagaagactgtcagtgaagggattaaggtgatcgagaatgttcaccagaagatacggcgatcttcctgaccccctctccaatccttcatagatcacagggagagaggctttctttagaggaaagcaacaatttatatttataggaggaaatgtttaaggagctaaattctcagttccctggacagccctgttgtttgatttgcagcttttcttaagtaaagcactgattctcaatgagagatgagcggcttggccaataatgcaatcagataaagtagggttttcagacctggtgggtgggcttgaagctgggactccttccctggcaccaagcttgcctttgtagtttgaactgagttagcataaacagcgggtgcaacactcagaagctgaattttctttagtttaatcctctttgtcctcctcttcaaagggaaaaatttgcaagcaatttgctgagacatgctcaagaattacctgccagagagaatatcagacatgacctcagataaggcaatgatgagaagggggattggagagaagagaaatgtggcactgaagtttattgaacatctattacatgccaggcactttacagacattctcatctaatcttcacagctgcaagagacagatagttttatctctgtttcacaaatgaggctctgtggggttaagtgacttgcctaggtcaaatgactcataagtggctgaactgggatttgatcttaggtttctaagcctgaggatcccctcctcgttccaaatctgtgctttcttctcacccctgctatgaggaaaagcttgcttgcttgcttgcttgcttgcttgcttgcttgctctctctctctctctctttctttctttcttaagacattcagctgtgattttctggaagcctgtggagtaggatgaaaatcgagtggctctcatatctatctactcctcgtctgtcactcacttcccttgtccctcactccttcttgatttcttttctcttgttctctacctctcatagtgggatgtgctcctttcttcttacatgtctctctcttgaggtggaggggttaaaggatgaggagagtgatgaagcagcagagcgtcaagtccttcatctctcacagtgtcctgtgcacgtttcattgcctttctgtgaagcccagtcaagggcgtgtagatggcccatgtttgctggttactgcttctgactgtcattttgactgcggatagacattgagtgaagtacccactctgtgcaaggcaccacagtgggtgccagaaaaaattattttgaagtggctaaattgaaatttccttaaaataaaaatgagtgtgcttacgttttgcctatttaggaaataggggctaaggagaaaggagtgaggaagccagaagaggaggcagcgaccctgcttaagaagccaaggagttccctggtatacaaagtgacagcttgatatgcagccttggcaacctgccctggtccactatatggtcactgcctggtctaaaacccttgagtgtccagggctccctgttaggtggcccatctccattgacactgctcaggtggtaccccatgcagattctctactctcttttctcttcccctgagatctatttaatgataaatgaaagaatgcatgaactggcctactctcaggatagatctgtgtgtgctttccaaagcccattcatctgggcaagacagggaaattggcgtgggccagagccccttaaaatgctctcaggtcaggtcagcctttcagagaagagtggctaatagtgaggattttaggtcaatgaagaggcgagaccagctgtgatgcccatgatgatgaagcccacgaagcagccactgcagtgcttggcccatggtaagtgcatcctgaaccttctagttagaatacatttggctgcaagtaacagagacccgttcagagtagctcaacaatcaagggtgtggtatttctttttttctctttctttcttttttttcttttttttttttgagatggggtctcactctgtcgcccaggctggagtgcagtggtgttatctcagctcactgcaacctttgcctcccgggttcaagcaattcttctgcctcagcctcctgagtagctgggactacaggtgcatgccaccatacccaactaattttttgtatttttagtagagacggggtttcaccgtgttagccaggatggttttgatctcctgaccttgtgatccgcctgcctcagcctcccaaagtgctgggattacaggcatgatccactgtgcccagccctaggggtgtggtatttcatgtgagagcttgagagcacatgtgactccagggtaggttaattcagctgcaacattacaagctcaagagcccaggctctctgtctttctactctgccttcctcagggtgagtagccgcccccagggtgatgggtggctgcagaagcccttggcaccttcacacacagctgcttgcagggggcaaaaaaggggcaagggtctttggagaacaaaaatctttcccgaaggccctcactggatttccttctttgtcccatttgctggggctgcctcacacgatgccaaagtcaatcactagagaaaagaacacaattcatagtctcaagctcgagtgcacatcagagtcactggagggtttgttaacacaggcattgctgggccccatccccagagtttctcattcagtaggtcgggggtagggcctgagaatttgcagttctaacaaaacctgccggtcctggggccacacattgaaatgcattgatttgaactattcagcaatcatctcccaggcccctgaagtacctagaagccccaaatctgaaaaaaagcagaggctctgtgagcaagaaggaaggaggaagtgcctgccaggtagtcacatcatctttaatttttggagttacagatggatatcaaacactgagattagtagaccaccagaggtggtggtggtggcttctctcctccccacccttttcttctgttcctcctcttcttcctcactgtaaacttcggtgccatctgaagcttctctctttctgaacatcacattcttccttgttttgtaatgggtacacccaaagcttaccatgttggggacattcagtcctgtggcaagggctgctggtctttcagtggaagctgagctgcccgagctcagccatcagggagcttgatgtggcggttacttctaaatgagcactcattattgatgttaattgaacttgaagttaatgaaaaaggattattttacagggcttaagttgaggccaaaattgttattacaggttaattattatccttaaaaggcaccattacagccatgattgttttttatcagctttttctctggtgctgagatttcttcgaaggcagattcctgatataattagtcacctcatctaattcttaatcaccaatcacttctctccagataaaggttaatcaaagggatgtgagttgggtactctcccttaatcgcatttgatcagtttcaaacaaaccctttcttctatttttgtttaggaatgtggcctttccccgtattttcaaacctaaaacttggaagaagaattcagaatgggttcaccgaaaaaatcagacaggcctgctatggacagctctaggctgcctggggctggggaaggtggcaggaaagagaggccctgaggccatggaactgtgtcacctgctgtcctttctcttcaccctccctctttcttttattcttccctttcccttttctcttcttctagtcttgcctttactccttccatcctccaacttcattttcacttctgtctgacttcaagctcataattttgcctttggatatgactgcttttctttcatcttctctttcccctttccacctctctctatagcacaagcctgcacactgggctagaactagggggaggctgtttggctcctgctactgaggaaatataacatgggccacaagaaggactctcaccgtacccagggagaagggcagggtacaggaggggcatggacatttgaggaaagcctgagaagggtaagggctcttccttgagagaaagggaaggctgaagggaataggattgagttacacaattataaaaagtcctaggtagaaggaggagagatttaatcaccaaatcccagggtaactgaatgagagaggaggtcttgaggctttagcaccctgtctcacagtgccacactgctgactggtggagggaggagccatcagggaaatcctgctgaaaagcctcccaagagaatcctccctggggcccccaccccaccacctcccactctgatgtccctggtaacagaacaaatgcacccttcccttcctctttacaattgtttttaaactgaagtattatttatgaaagtgacatgtgaatgtactctcctttttctttactttttccttctttttattgttatttatttattaattaattttttttttgagatggagtctcactctgtccaggctggagtacagtggtacgatttcagctcactgaaacctctgcctccgagtagctgcagaaccacttgcaacctcaggtggttctcctgcctcagccttccgagtagctgggattacaggcacctatcaacatgcccagctaatttttgtatttttagtagagacggggtttcaccatgttggccaggctggtcttgaactcttgacctcaagtgttccacccacctcagcctcccaaagtgttgggattacaggcatgagccaccgcgcctggcctctgctaactttttaaaggtggattgtagatctctatttacatctatgtctatctatatctaagctctgctttgctcaaaacatcaacctaggctctttctccttcactagaggtaacctgtgttaatagcttggtgtgtattcttcccaatatttccatgtatttacacaatacagaaacctgcctgtgtgaggtaatgaaaaacccaagctgagcatcttcttacaatgaacttttactgtccaatgggatcatgtggaggtgcgtgatggagattttattcttcttacaatgaacttttattgtccaatgggatcatgtggaggtgctccacacttgtcttagcttgctagagctgccatcagaaaatcctacagaatgggaagcttaagcagcagaaatttattttctcacagttcttgaggctagaagtccaaggttaaggtgccacaggtgggtttctcctgagacctctctccttgatttgcaggtggctgtcttctctccttgtccttgcagagccttttctctttgtctcttcctcttcttataaggatgtgaatcctgttagattagagccccacccttattgacctcatttaaccttaattacctatttaaaggctggatctccaaatgcagtcacattggggattagggcttcaacagatgaatgaacgtgactcagcccgtaacagcacaaaatctgccctcccagctctgtgcttttgtcaagacattccctcttgggggtcggaggtaccctttgtattcttcttcatcttggcaaatgttcttcgtaccttaagtctccactcaaatgtcaactcctctaagacccatttcctctgcagcccggctccctgcttccacacaagggctttgtgctccccaagagcttgtgacccctgccttgtaggagctctttttgtcctgcagcttctgtggcagtttgtctccctgcacccacactaccatacctactctcccattgcaggaaacagttcatggatcctagggacacattcagtaagtttcccttacttcaggatggagagagctgtgtcagaatgttctggcatcaaacacaggttgtggggaatgtagggaagaccagggaaaaacacagacccataacctgtagcctaccctctttcttcaccccaagccactgagaatactggacagccagtatctcactcctgtggtcctcttttcaaaaacacatcggccaaaagaaatgacctaggagagcagataaactggccaataagatggtaattaagcagatggaggctcacaatgaactgttgaattgagatggctagggatctcctgaactaagccactggaaggactactaaaaggcacatatcatctagaaggaataaaataataaactatggccaatcatgcaacactcatttaaaagaccatgaattcctttctgcattgtttcctttctgtgggtttctgaaggcattggtgttgttaaggcattctggtgctggaccatagtatagccaggctcacagccacagaccagggatccctggagctgcagcttcctgcttccagcctcaattcttgtctctctgccaagcctttcagtcttaaactttcagctcattgcccattctcctttaaagaaaagctctgtgttttaacctttgttcactctcaatgtctttcggaatgaaaaaagactttctaatggaatcccagtgcactgcagtgtggtctgccttcccaagttgtcacccctccacagtgcagagtgctggggaggaggtcatcccaagtaacaactttcagagctaattaaggttttacatcattctagagaattaggatcaaccagcggcccttgtgtgtaacttgccaaatccaaatcctgccttatctccaggcataaaagctacattaagttttaagacctgattcaaaaacacattatggataatgatgacaccttgatattaagtcttcagaaaggaagcacatgacttgacatatggagcacatgacttgacatatggaggttttaccactgatggaaacatggggctttttatggttcccattgattgttaaacaaatgctacatctctctataggagatattgaccaccaagtgcatttaagaggagtatgtcggggtgtgtgtgtgtgtgtgtgtgtgtttgtgtgtgtgtgtgtgtgtttgaagcatcacattctcacagatactagtatgttcccgtcatcctcctagaaaagcaaaatagttgagaattaaaagggagtccagaatcacagaatactgcattcaaaaaggtgctttagaagtaagaatgaaacattaatagaatgatatcaccctgatttttaaaatttaatttttctgtactagaagaaattatcctggacttgaagtcattctgcttggggttttgctggtccccactaatttactaagttatcttagataagttattgatagtttttttccctgctccccctccccaggttattggtagttgtgagagctaacactttgttgaatgttttctcccctgcaaaagtcaggcttaacctccatttctcatgtagccctcccagcaatgccacgtgggggatagtattgcttttcccatttcacagaggcttagagaggttgtcccttgcccaagtatctcactgttcagttgtggagcaggagctcaggactcctggatccccaaacacctgcccttagcccccatgctatgttgcctcccctgggtttaacaccaccatccacaacagcaacaaatattcactgggggctaccatgagccaggcactgtgaaggaaacagacatggcccctgccctcagagtttgcagatgaggacagccaagttctctctgggtttcttgatcattttctattataagaaaagggtttgggtccttgacacccctttcaacttgaaagtttatgagcacttaaattatttgcagtgacttctagttttccatttcttcattcgtatcaccagttacatgcttatattgggtgactgtcatgtgccaagcactctgctaagggtttttgtagaactactgaattttgtcctcatatcagtccataagagactttaaatgaggaaatggaggttcagagtttaccttgctcaaggtcattctgcttgtaaatgtcagaactgggatttgaacccagctctgtcagctccatgcttttccccatagaagaaacttcttgagccactgttcttgaaattcagtaagttccattcatttaaacaagctaatttctattattacagatattatggaaacagtaatctacgtaactgagtcatctggaagcctgtgctgcagtctgcttattagaggcaggattgtataccagggaattcagacctgaacaggacctaaaccttggtgtttggttgccaagctgagaaagaatcctggaacattccccacagtgaaagttaacattttgccacttagaatcaaattcgggaggttgttagttataacaacaataacaataacacaaagaactaatatttatacacctctttatagtttccctggcccttccacatccattttcttatttgataagaagaaaagaataatggaatgaattgggagctggtgaacatataaaatgatattgaggctgcatggcagaaagtcagagcaatgagaaaaaggagcagggtcactcatcagaagcagatgggcttatctttaaatacctgatcaggaaggcagctgagcagtagataaatgtaaaaaggaccatgaagctgagaataaatggagcaatctttttctgaatggaaagtggctgaaatcccagggccagggaaggggaggggtggaaatattcaagaattatggcctgagaagaatccctaaagctgtcaggcagcaggggcgacaacagcacatcaggagtggcccagaatagatggccccataaatcaaggagggaaacattatggccagcgcaaggcagtactgtgccctaatggggaatgggctggaggactttataaagctgggttggccaggctctgggcacaatggaattgaccaagtcaaccttggaaaggctcaaaattcagcatgttttaaaaaaatggactagtgggtgcttagatcattctgagtatccacaagtcattctcccccctctaccacaagcttacttaaaaggaagaagtattatacacagttgggaagtatgtgtgtgggagcagggaagaagatgcattctcattgcattaatgtgcgtagagtcagtctggagtgtggggacagtctgggctctagcgtgggtggtcatggtgtcaagtcttaggtctgccacttacgaatcatgtgaccaatcccttcagctctcagccttcagattttctctatagaacagggacagtaataccttaataattgctcattgtgagggtccaatgggctgattgattgtaaagtgcttagcacagggtttagtgcagataagtgattagaagcaattattagaggggacagtggaactacccttcattcagaaatcacagtccaacagatgaagagtatagtggacagttttcacttggttatgctgcgtgaataacctcaaattcttgatactttccaacaactttattattgatgttgcttgttggtgcagtgggatggctgctgctcttcttcaggctgtcagtagattcagatctgctccatgcatcttcccatcctgtgattcaagatgaaagggcatctcctatgtgagctgaatattctcagattggaggaaactagtgcaagagagctctgagagcctcttgaaactgccacattgccccttctgcacacattccaatcagcaaaggaaatcttgaagccaaggccaacatcagtggacaggaaaccacatccttccatggtgggggtgcaggtagtaggtaagactgaatatttgcaagagagtaatagggtgtgcctcaaagggcatggttaggaccatggttgtacatagaaagccggttgactgggttagggagagattggttgaactcagtcaagccaccatttactaaagcaaaagacatgtggtcagagaatgagcttttgctgaatctttctcttgatgctagcattgtacagagagaagctggatgtcaggaagactgtgcccttccttgcagtcctgctgcatctaagcttccacctgtgacatggcactgaccttccttatcagccccttcagctcctaggcttgggtagcatgtggtcccagggaagtgtgaactgatggtgagtcattctctctctaagcagttggatgtgaatattaacacttgtttcccaggcagcatcagaattcagcattttcttatagttcttatggttctccccagaactataaaatgttctactttatgggcctcagatttgtcatttttaaatgagatgggatagagtgatctctaaggccatttgcagttcctatggtctatgaccatgatgattttacaagtgtagagaaggcatctgaagtgcttgatctgaaacatgctaatgcagataagtgttatgtcaacattgtgcttatttaagatgcatagtgttacccacattactgtaagtagagattgtcacccggcatcctctctaggtctcctgtaccctggagtttctcctactctcacctctttttaaaaatctgctgcaagacatccttaaactgtgcatgcctaatcattgttaacactcttgaagaagatgagcctttacccccaaaggaaggcctttctaatactgtgatgttacaggtgtatggaggaagacattttagggcaggaaggcccctctttttcctctattccaatttgataaatacttataaagcatccattaggtttccccccaagctatgtgctttcatttatgttgtctcttttaatcctcacaaaacccccttgaagaaaatattactatccccatttttatagatagagaacaccgagttccagagaagttaacttacccagtcatacagccaggaacagcaggtgtgagattcaaacttaggtcttcttcactgaaatttccattctattcagttcctcttttattatgttttgagaagatgtgtgctgagctatgagttgggggcttccttccaagacttgagaagtcttctggcctgtgtggcctgaggcaagtctccaataacacagaattgaggcaagggaacggttagctaccaggagaccttggttcttagatggggggacacagctgattaagtcactggcttaagatgagtcgtatatgtgaagcaggactgatggcagctaccctgccacccgctcagagattcagaggggccgtggagagagaatatacgtaaaaattctttgtaaactgtttaacatcattcaaatagatgacaatgttgttggttctctttagaaggaaatgggaacaaacctaactgccattttccctcaacagaggttctgcctgaaaaggcaatcctgtcccctaaaatgtttgttttgagggttctaggacacggcaaagaatatcacgcctataacctttttgtagtagagagtacaacagagaatttcagactcacttttagaaaactcagggcatagaaatccagatttctaccaaaggcattggtggattcaggcccaggcctgtttgactctggaaacttccactgtttcattctgaaacagtactaatacttaggttaggtatggtactaaaaggggttaccaaacataagacatagcccccttcattctagtggcacatggtctgcttgaggtgggaaaaggcacactgacataaaacagcaaaaccaaagtgctaaggggcagagggcatagagtcaattgtcaagataaatgcctggttaaagacccagcagagcttgtctctctcctacttgcagatgctctatgttcagctgagagtgcaaatggcctggaaatccttgcttaggggactggaaacctctggatgtacacgttttgaagcatttctctacaatgtctttgtaaagcatcttgctgtcttggtttttcagcttgctttcacaagagggtccagcaacagctggtggttgttcttatccttcaataacttgggtcataaagagatgaaatgactacacagtcatccaggactagcagtactggagtctgtgtccatcacagggcctttatgcacctcacctgcctgccctcctggtttctctctctctctctctctctctctctctctctctctctctctctctctctctctctctctctctgtctatctatctatatagatacagatagatagatattccacaacagtactgggggtctgtgcatggccagacccaggaagtgggtgttttcccctgctgtctctctgctgtcactttctctcggctgtcactttctctccacagcctccccactactatctatctatctatctatctatccatccatccatctattatttaaaggaaaaagtcattttaaagaaaatagatcctgtgggaatgataatttataacacctgataatctagacattgccatattttatcaagaggtttacatttcctgtaatcctgctttgaatggtatcattccttaaataagcaagtaaacattagtaaataaaattgtgttaacattgctcattagcttatatgtgatatatatagagagtatatgatatatatgtgtatatatatatatgtgtatatatatttttcctttctttccactgcagagaaaccattgtatatccctggaaacatttatttctatttaaatgtgctttaaaatgcaactaagtaaaaagacagaactttttaagaagaaagcttaatataaatctagccagactagatttatattcaaagtcactttttggttcaaattaacttctactcagtggttttcaaactgtgtttggagacagagatgctcccacagttgattcagtcacagctactcactcttgttggttttatacattgggattccccttaggacttcacttaacaaaatgttctatttcaactaaacagcttgaaaattccacttttacaccaacagcgagttccccaggagtcagaaggaaatggtgtattggatgttacggtaacaacatttttctgattgtgaggaaacatcttagaaattggcatgtaacttttttttaaagtggtttttcaatgaaaatgtaaaagatgcaaaaattttggatatagtaagagggactcctttttgggaaattaataggaattcatggacatatatcaaattttacttctgtgaaatttcagtactccagagctaattaggtatactgaacagaaatattaacaattcctttcaggtaagctggagcgtgcatttcaatgccactggtgccatgtgcctctgagttcggaagctggttcggtagctggaacagcccaccccagtggaaattctacacagggcaaaatctgcacttgtttcgatgggaaaaagggaaaagtccctttaaagaaagttggtcctatgggaatgataatttataacagctgataattaatctagacatcaccatattttatcttgatgtttatatttcttctaatcctgctttgaattgtatcattccttaagtaagcaagtaaatgttagtaaataaaattgtgatcattgatcattagcttaatacatagtttccctttttttaaaaaaaaaaaaaaacaatttattggaccatgtgctcaatgtctacaggcccaatcctccacagctaggaacagccatggtaattggataattgacttatattgccagaaaccaagacatcaatatttactagttagcaactagctgagtcacagctatcccacgagcctctaagaggtgataaaccaccagtgagtcctcctctcacagttagctttttggacttactctctcctcaaagtggatggtagagaaaaggtacccagagggctttatgattacctgacctgacattctctgccaaaggttttcctggtagcccttttaggttctcttgtgaaatctaaacacagggatgtttctttcttttgaagtaaaggtctcttaacatagcagtccttccagtaagcacaagaaaagattggctgtctgagttttaaattaaatgaagctaaccaggaatgagacaacaggaacagtaacagaattttggtgcaatggaagatacaacataatgggcttgtcaagcctttcctacccacagtgtgacttttaaaatgtccatactggcatcacttgggaatctgttaaaaatgtagaatccaaggcccaaccctcaggcctacccaaccagaatctgcactttgacaagattcccaggatggcagtttaaaaatataggcccaaagtccttgatcctctctcattgagaggtgatgggctctatgtccctccccttgaatctaggcaggcttgtgactgtttgactaatagtgtgtggcagaaatgacccaggatgacttctgagcataggacagaaaaggtcgtgcagctttctcctgattctcttgagatgctaactttgggagaagccagccgccatttaagacttccaagtgctctgagatacccatgaagacactgtggccaacagccccagctaagcccagacttcctgctattcttgctagattgtcaggcatatgaatgaagccaccctgtgccctcaagaccagctatctgccagctgaataccaacaagtgactccagctcatgccacatggaacagaagaatcaactagttaaaaccatgcctgaattttgtaactatggcatttatgagatataatacaatggttgttgctttaaaccactaaattttggggatagtttgttaggcagcaagctaactgtaggcccagtaaaatgtgaaagcactggacaaaacagcaataatcaatcattcagggaggcattgagaaaagtccacagagtagtcaaaatgcttgggtgggttaaaatattcctgatttcaagtgagaatgttcctcattcagtctttctcttcccttctttactgtgtaaaccatgggaaaccttctgataagaatttgaaaattggcatttaataaatatccaatttgccaggtgttgagctaagcgctgtgctgtgttatatcagctaatcttcataaaaaccttttgagctaggtataatgattcccatgttgtaaatgatggaactgaggccaaaaggggtgatataacttgtgcaaagtgaacttctggaagttaaatataggtctgtcttacttgagtgtctctttcacccgggttttgatggcatgagactgagatgcacttgaccacagtcctgacaaggtagtgttagctaagggcaatcttccttctttctcttcccttgtgggaggaagtggacatggctggggccataggcctgagttttgagttacatctctttttctgtttagtctcttataaaagggctaacaaagatgaaggtacaggcaaatagataggtatagggccagggtactacacatgcatgatggattattcttagttaactggctgaaatgtacacttgacttttcaacaacccctgcacagttgaccctttacacagtcaaaaatccaagtagaacatttgacttcccaaaaacataactactattatgattaaccactaatagcatactgttgactgaaagtcttactgataacataaacagtcagttaacacatactttgcatattatgtgtattttatactgtgttcttacaataaaataagccagaggaaaggaaatgttattaacacaactataaaaaagagaaaatacgtttactatttattaagtggaagtggatcattacaaaggtcttcattatcttcaagttgagtaggctgaggaggaggaggaaaagggtgggttggtcttgctatctcagaggtggcaggagcagaagaggtggaggaggtggaagagaaggcaggagaggcaggcatatatggtgtaactttatggaaatacctagtaatttctgtctgacttttttgctttctcatttctctaaaaatgtttctatacaatatcaattcttcttccaccatgtactttagtttcagcaccctcatagaaggatacatgttgcaaaagaagtaaaaagtagttttgagtaattagaaccctttttctggattgtctactgtcaatttgttttctggaactgcttcttctgtgtcttcctcctcatcatctggcactggtttggaggcactcatctccatcaagtcattttctgttaattcctttggtgtggtttctattagctcttgaacttctccaacacccatatcttgaaagcattcattctccaccctttttttttttttgccatatccataatctctttcatgatttccttgattgtcataaatcctgcaaagtcatatacaaaacctgggcatggttttctcaagcaggaattgattgttttgggcttgatgactttcacaacgttttctataacaacagtggcatattcaatggtgtaatcctttcagactttcgtgatgttctgtttgttggggttctcttccacagcattgacaatcctttccatagagtatcatgtgtaatgagccttaaaggtccttgtgaccccctgatctagaggctgaactacagacattgtgtttggaggcaagtagaatacttcagtgccttcattgttgaacttacaggtttctgggcaacaaggggcattatccaatatcaaaataactttaaagggtagtcccttactagcaaggtacttcctgattttagagacaaagcattaaggacaccaatccagaaaaagggtctcagcatctaggccttcttgtataactccaaacctgtcgcttttctcttcaaggtttaggagttagcagctgtattgataagtcctgatcataaacccatctgcatttgcacaaaatggtagagttagcctatcccttcctcccttgaatcatggtgctcacttctgttcgttactcataaatgtgctttgtggccatttcttttctgagtagggtactttaatctgcattaaaaatctattcaggcagatatcctttctcctagataattttcttcatggcatctaaaactcttctgttgtctcttggtcagcagaagctgcttccctgttatcttgacatttttataacccaaactttttcttaaaattatcaaaccatcctttgctgacattaccttctccagttttagatccttcaccttccttttgctctaagttgttacataataacttggctttttctcaaatcacattagactctataggtatggctttcttataacaatcctgcattcatataaaagctttattttcaatctgacataaaaacgtatttaccccaaagtgcaaggtttttatgcctgcaggtgtagccacagcaatggcttcacatttttttttttacaatggtctttatgctggattcatttatcttgaaatggctggcagctgcagacctcaatctatggcacatatcaagcaattcatctttttcttgtaacgtcatgacttttctctgcttcttgggagcagttccagcatcactactgtcactttgtatgggtcccatggtgttattaaaggtttacagtattgcactaaacatgatgaataatatgtgagaactatgagagatcacattttactatgatatgaaatttactggagagaaaactactcatgttttttttaacatgaagattttaaacagattcaacacttgacctcttgcaatagtaacaggtggttatgaaactattacagtagtacagtattaactaaaattaatttcatagttatgatttaatgctgcatctttacatttgttcacatttctctcaattatgaacaatgccatgtacagtctgtgtttgtgtgcacaataagttttaatacattttaacttatagatttgtgtatgttttatggtagtaaatgataaaatagactagtatctacatatattttatgattcataacatacataactttttcttattttttgatatttccaggctatgtactatatctgtgagttttctcaaactgtcacaaatctccaaaaaattttccaatatatttattgaaaaaaattcacatgtaagtggacccgtgcggtccaaactcctgttgttcaaaggttatccatatttaattggcatatgagaaaattccatcttactcttcaaggagtgagcaggtctgagcctagtttttaccccactgaatctgagttagttggcttctctgtattcatctcttgggaaaagaacatgtttcaattcagcattctttactgagggcccctgtgagcctggtgttatgctagacacagttggggagatacagtggtagacaagtcacagcacccatcctcagaaattcatcatcatgcaccaaggaatatcacagggcagaggccagaggatggagagtctgggaaggttttctggtgaagatggcctaaacctgggccttgaaggaattcactgaaaataaatgagcttaacagcattaaggcagtaggatacttaaaggaaaaacctagaataaggaaaagaccaggttggggaatggctggcagacctcagtagctggagttagcacaggcttggttgctggataaccattgttttgacctgcctaacagggaagtaagggattctttaatgctgtacttcttttcttttcttttcctttcctttcctcttttctttttctttttctttttttcttttaccttcccttcccttcctttcttccttcctccttcctctctcccttcctctctctgtcgtctctctctctcaccctctgctcccttccttccttccttcatgaaaaaattctctatcaatataaacattaagcttatttgcacttccgtttatgaccaaggaaaaacattagagtaataggtagagtgaccagctttagcaaataaaaatacatgatgatcagttaagtttgaacttcagataatcacatctgatgtttacaatatttgggatacacatcactaaaagttgtatttgttgtttatctgaaagtcaaaatttaactgggtgtcctggattttatctggcaactttagcattaggtaaacataaacagcccttttgacttctcaagccaggtgaagtgatgcctccttggtattatctagttcgttgtcgttgttgttgcctgtctgtcgccaggctggagtgcagtggcgcaatctcggctccctgcaacctccgcctcccaggttcaagtgattctcctgcctcagcctcctgagtaactgggactacaggtgcgcaccaccacacccagctaatttttgtatttttattagagacggggtttcaccatgttggccaggctggtcttgatctcttgaccttgtgatgcacctgcctcagcctccgaaagtgctgggattacaggcatgagccactgcgcccagcctggtattatctagtttttataaacaaattaagtttcaatttaactcactgtaatggtttatattgagacattatgttttgcttcatagtttttattatttccattttttagaaaaatgacttgtttgcaatttgtggcttggtttcttcttgtctggctttattctcttgattttaaactttccggtctgacagtcgagttctagaagttgttctgcttcaaatccctcgagatttgttttgaggggacatcgatgctctcacacctacagtccttcacaaccttttcatggccagcttagaaatgattaagtttattgaggcaacctcagacggagtccctgtttgcagatggaggaattgggtggggggactgtgatgtgtgtgtgtgggtcttcactgagctgctgaagggctgagggtcagatcagaagggcagagccaaaaaagtcacaccccattctgcaggctcctttggccttctgaactgaggaagctctagttgtttctccctccaatctgctgggagtagaaactacagaaaatttgaggtttaaaatgagggaaaatgggggagtacaggtaatgaaagtaataatgagaaaataattcattttcacttggaaaaggtgaagaggatcattttgacttggaaaagatgaagagggtgggggattgggaaaagtttcatggaggaagaggcatttcagctgagccttaaaacagctgggtagaacttttgccccattcttgcctgtgaaatttcctttcctctcccagttctacctcattactttgtaaagagtttaaagcccacgcaggaggcggggagacagccagcagcctgttgtgtctggacaagctggcaggagggcccgccccacaagtacaaaagtttgccatgcctgacaatgccaccatgccctttgctccaaagtcagaacaattaagccccatctatctttcttgcatcctggaagacacagaaatgctcctctctgaaatttgataaaagcaccaacctgccaatcagaagagggaagatcataattaatgataatagcctggttttaattatagctatttagcaagttagcagaacaataccagtaaaacagctctacactgagtgggtcgggagcagcctgctgcttccttcagcgttcacttagtggccctggaactttgcaaggctcagctctttggaaatggagggattggaaatgagggcaaagcagcctgcattcctctttctccaggaagagatttctacctttctctgttccatacaatttgcaggtgcatctagcatgagctggttgtccgtgagactacacagttgaagacggacctacgttctgttggagtagaggcaagagctcagaaatgcatattacagtgaggccccttagttgaactgtccacccttggctcctttctctgtccggggccagatctagactactaaaaagttaactctggaaggaaatttagagaccctttaatccagagagcttcaaaattttaaaggccagaaaagcagctctaactgaagaggaagaatgagaaagtggccacaaaaccttgcttccagcctccatcttgccaatggctatagccccatggttgctccatgaaacacttaggattccttaaagaagcaatttttcaggctcacttttatggcatgggtactagaagaaatgtggctttcccataaccaagcacatagatattgtgagaattaaaacccagatctcccctttcctccgaggcgtgtgtgtttatgatatcccacttgggctattctttcagcactgaaaatccaaatatacctagccatagatccctggggacttataaagtaggagcttaagtgggggtgggtgacagccactaagtcaatggcttttaatttggtccaaagtggggagtccatagctttcatcagcttttcagcaggatctgtgaccccccaacatttaaaaccactgccctgaggttactcagcaactcagccaagggctctgatacaccccgacttcctgcttccttctgaggtcagaccatcaccccattcctgccctggggtacatctgcctggccagctggtttttcctacttcacagctaattctgatatgaccaggacccaatcaagatagaagctgataggcaacaaaggtatggagcaggatggagaggagactgcctcccaaggcagccaggggaagattttctctgagagatgataaagtggccttgtcattaatgaggcagacatctctccaaggatgggtctgcagaaaagatggcatttcccaaatcccctttctgacaagacagcagcctctaacagatgaagaggaaatctgtagtatggagcttcttggatctgctttaaatctgccatgggacattggcagttggagaaaatcatctcaggtgataaagagttggattagcatcagatgactgtgaagtaataatttgtccctttgaaataattcaggcggcctttcttttctttgacagattcaggtccatgaagtttcggccttgttagttatcagatttacaggaaacctactgactgcttcttaccaaagggaagagaagtttttccctaaaagaaaagcattcttttgggatgaatgacctagcattcatcctttctcttccctttcataagtgggcacgtcctctttgtttcttaggaacaatcactctgtcactttggggagaaaaggatagaataagtaccccattgtttgagtcaagctgaatgaaccattatcttaaacgtgagtccttcagaccctactttcccatgctgtcagtctcctaggacatgagtggacagtgggatttgtttgggaggtgtctgatgcctaaagagctggagcagaatagtttaaaacaggttgccatagacagtcattgatgagataaggagcttgcacaaggatgtaaatcaccttcatcactaagtttacaagttagttcagttgacactttttttccttgcaagacctttttgatggaggaagcagtgtgttgctgcatgcatagttgcacactgcttacctgatcaaccacaagcactttggtttaaaataagagtatttccttgtaagctgttttgtctaaagtttggaagttttccaagccaaattcttttagaatccaagaaaactgcttgggggagggattctcattctctgggtcaggatcgtgtgtcctgggctgccatgcaggcataggctatgtgtggacagtagccctttagtaccacgcaggggtgggtcatatatcctggttcactgagttcaaaggatcttgtgtctttggagtcaaagaatgctgggtagaattgacttctgctgactgacactccctggcatcagtcctgtttcttgcctgcatactgtgtgggttttctgcttcgactttagccaactagactactatgtttctctgcagcattttgccctggattctctccctactccatctaccagcctcaccttctcaactctggattcctggccagcactgtcccctgattttactttcctcttagacctagtaaccctgtatcccacatatctgtcaactacaatgctttccagctccccacccagctctctgctgtgtctactgtcactgcactggctgaacctccattccttagagtcctccttgctccataatctcatgagatgacagttcctttatcatagtaattggcaacttgtttatcctccaaggaagactggaaatttctaagccccaatagtgacctcgacctactagtaacatccaggtctgagctaggggaagttgttttaaaatgcctcaacaggacctttcagcatatttgcctaggaatgatggctaaaagaacaaaacttaggcttgggattaaatatggaccttacaatttaccagttgttagatctcaggcaagtcatgtgagcctcagtttctcaatctataaaatacaaatgactgcaggaatgttgtgagagtaatagaggcagtgaacagtgtacttaatacaggcttggcttataatagttttcgttattttcaatcaacctcctagagacctaatttcccaaaggcttataactttttctctcgatttctgtgcctcttgcccttcctcggtgggtagaatactgcagctccacactaatatttcttggaggcaatcaaatccctttacaaatggtaaacaggtggcttcttgctaaacaaaaagctgtgtacttgattgatcctgcaatccaacaaaatgaaggaggtagctttttatcttgtacaatggatgaaaagccattcttatcaaacaatgttctactcagcttttctcccaagttggggtggatgggataatgccctctacagattatggtaaacaggtgggcccactaccctataatctggtagtcatgtctctcttctgggtctgggaaggaagccagaatcctagggttgggcagagggaataggaggtttcctgcctttgctttactgggaaccatatggcagccagtcattccatggggaaaagcagcctcctggattctcccctaggagccaggaggcaaccacaaggagcagcgcttttgccttgaagacctgactccgaaagtacaggtaggcagagcagagccagcgtgtgggaggggtgtgggagtggggtcgtcacccatgatatgctgctacgtctgtgaaattctgagccaatgagatagttggtggactgaggcctcatgaattcattcagttaaacaatgaactgacttacccactgaatgaatgaatgaatgaatgattacttaatacctactatgtgataggcatggtctaggcgctagggatacagcagtgaaccaaacagaaaaaagtttctgctgtcatggtgtttatattccagaggagagaacagacaataagccaaaaaatacatgctggtaagggtcagggagaaaatgaagcctgggaagggacagacagtgataggacagtggtgctcatttacataggatggacagggaaggcctctatgacaagctggtgttagaccaagaatgggaatggcatgagagacagagccatgaggatatctggaggaagagcacttaaggcagaggaaacagcaagtacaaaaagtctgaggtgtgagtgtattttggctcacatcagcctccaacttaacttataaacaggcaaaaagaagttatatatttatgtttatttttgatatgcaaatgtgataccacaagagtcaaaggagacactgatccttaagaaaattacttcgttgaacctctgataatgtaaatatgttggattggattagctctaagctctcttccagtttggagggtctgatttttactatgagtcctgggaggttagatatttcagggagaagtcaggaccaaggaagctaagaaagatggaaggatggacaagaaaaaactggtgggacagggcctgagagctggttcaatgcaaaggtgggatctacaaacacagagcattctaaagggagaaaggatcattattgtcatcttcaccttcattatcatccccaacaccaccatcatcattatcaccaccatcatcaccatcatcatcaccatcaccaccatcatcattaccatcaccaccatcatcatcaccatcaccaccatcaccatcactaccatcaccatatcaccatcgttaccatcatcaccaccatcgccgtcaccatcatcaccatcaccgccatcaccaccatcagcattattgccatcaccattaccattaccaccatcaccaccaccatcagcatcatcattaccatcaccaccattaccactaccatcaccatcaccatcatcattaccattaccaccattaccactaccatcaccatcaccaccatcatcacaattgccatcaccatcatcctcaccactaccatcaccatcaccacaccacatcaccatcaccaccatcatcaccatcatcattatcactatcaccaccatcaccaccattaccactaccatcaccatcaccaccaccaccaccatcaccatcaccaccactgtcatcaccactgtcatcattaccatcactgctaacatttaatgagtttatcatgtgccagacattggactaagcatcttttgtattatttcctttaatcctgacaacaatagtatgcagttgagagtattatccccattttatgtatgagaaaactgagaatcagaaacataaagtaagctgcccatggccatagaactggcaaaggcagggtagataacagaatataatctcaacacacacacatattgctaggcagtgcccgtagtccagagtgaggatgaagcagagaaaaacagacaagggtggggagggccagggaaaccagaaacaccatttgactcagcaatcccattactgggtagatacccaaaggattataaatcattctactctaaaagcacatgtacatgtatgtttcttgcagcactatttacaatagcaaagacttggaaccaataaaaatgcccatcaatgatagactggataaagaaaatgtggcacatacacaccatggaatactatgcagccataaaaaaatgagttcatgtcttttgcagggacatggataaagctgggaaccatcattctcagcaagctaacacagcaacagaaaaccaaacaccacatgttctcactcataagtgggaattgaacaacgagaacacatggacacagtgggaggaacatcacacgccggggcctgtcgggggtaggggacaaggagagggagagcattaggagaaatacctaatgcatgcagggcttaaaacctagatgatgggttgataggtgcagcaaaccaccgtggcacaggtatacctatataacaaacctgcacattcagcacatgtatcccagaacttaaagtaaaatgtaaaaaaatagtaatggtaaaaaaagaaatattttattgtggtaagtgtacaattgagtgacattaagtccatttacaatgttgtgccaccctcaccattatccatttctagaacttgttcatcatctttaatagaaactctgtactcattaagcaatgactccccattcccccaccctagtaacctctagtctactttctgtctctatttatttgcatgtatcagaatttcattcttttctgaggcttgaatgatattccattgtataaatataccacattttgtttgttctttcatctattgatggtcatttgggttatttctaccttttgactattgtgaataattctatgaacattggtttataggtatctgagcctttgctttcaattcttttgagtgtgtacctaggagtggaattgccggatcacatgctaattctatatttaacttcctgaggacctgccaaatacaggaatgttttctaaagctctttaggtgattctaatgtgcagtcaggccagaagagctgagtacaggtagggactgataaggaagttcacttgatgagcagggggaaggtgggcactaggaataaagacgtatcttggtgtgaagtccaaggtgtttgtatctgtgcctccaatgtcatttacaaaggcccctctgatatgggaattactaccctttgaatcaagaatccactcttgtctcccctgttgctttcttgtgggattttctgaaaatgattttcccatgtatatttctatgcaaacttgtctcatgcttgctttccttctctcttcctggcatattgagaaatgacattggtaatttggagacaaaatccccaaagagcttgaacaacatcagtagtatttcatctaggtgcatgtgggccgggaggtcctgtccaaggcatagtaactgctttaggtaagggttccagcactagccctgacttaaattgtccaaattttcatgttgtctgagttcttctcaagagagaggaaaacatctgatctggcttatctgatatttcactgagtgtctttgggtttagcttgtcattgccaaggtttatttcaactatgtcagcctttgtcacacgaacacagcacttttcgtactgggcttgagttgacagtcatcaaacattgcttggtcctgggtggcgggggtggggtggggaccagagaagaaagccatagagaagggaataatctcaccattttttgaagtcacaagaacagtcataccaacaagtgcttctgtatgcataaatccttgagcaatggtacaagagaatttgtccatacattccagtgcattgctatatttggtcagtagttaatgggtgctttgatggtggagcaattcctgcttagggttggggaggtcattgtaaggaggatcctttatggaaccggtatttcttccactgctaaatttgggttctgctgaaagaaagtgcttccagtacaaaccaggttcccatggaatctgctttattgtccagaggctactgctttgttggggacattaaaagcgattttgatgcccagagtggaggtgattatcaggcggttattgctacccagtcattatcactgctatcctgggtaatgatgttctgcttgtcttggtggcattttcatatcagaggaactcaggaagggtgagttcagctccatgggcccctgctttgcccaggaagaggccacgatgaggcatctgcttcttcctgtctggcttcgtttaagactgactttgactccagatgctcaattctcttcctagaatttggctttaggcaccttctggattctgtctctgggcatatttctagcatcttggtttgctccactgattttagttgtcccttatacttcccatctctgacttggaacaaacccttgagcacagtcctcatcactgtcccccatcaccattccaggtttcccattctcagtgcctgcacctgacaaatgccagcactctggttctgccccagcttctgttgctccagtggcatgtgctgacctggcttcagaagctctctgggtcccagcacacatcttttctgcagccgcttcctccaccccctacaaatgtcattctggctctggatatggtatttgggagtattgaggagaagaggcatctgaaatcaagccaccaaattctagactttttatcattaatcatgagaaatgacacttggatctcttgcctgtttgagatgggagcccatagcactgagctgtcactttgataaaacatctgtcagtggttggagccacagcccagggtggataccaccagtgcccctgactcctggagggagtgtggctggagatacagtcagctgaggagctcacactgtctaagacactttcaaagaagcctttgggaattccctggaactcttccgaggagagatgttgtgtgtctcttaaaccacttgctttttgacttgcaaatgttgcagtccaacaagttcttctgaatgcacacatctttgggcagtgggacagaggatttgtctgtacattcctttgcccaacttgaaagtgaagagagctacttttgggcagatctatggcagagattagaaaattgaaatttaaagaaacatagttataagagaccttagtgattatagagggtcactgacttacagtaggttgacttatgatttttcgactttataataatgcaaaagtgatacgtagtcagtagaaactgtacttcaaaatttgaattttgaaattttcctgggccaatgatatgcagtatgatacccttttgcaatgctgggcagcagcagcgaacaaaggcttccagtcagccacacaaccatgaggataaacaacagtctatggtatactgtcctgccaggtgattttccccaactgtgggctaatgtaagtgttctgagcacatttaaggtagcctaggctaacctatgatgttgtattaaatgcacttttgacttacaatattttcaattactctgggtttatcaggacataaccccactgtaagctgaggaacgtctgtatctagtttaactacctgttttgtctgctcaccaagtgaggaaattgaggcttggaaggatttcaggatgtccttaatatcatgctctctgcagttcagctgcatcccctcccctgctctgtacttaaattccttgactcccaacaccttcaattcttctgaattaagaatgtttcagataccagttcagtcaactccctgtcattgttcaaatattctggggtctcctctctgaaagcctctgagcttaatcaaaaggagaagcaagtggagagtgtgaggtttcctgaagcttggatctgtgggtcagtgtgtccagcatgccatgagatctatgtcagccacgtacttactgatacccagtctagggcttggaggacaatgggctgcctggtttctttggccaggaaggcatgttagaagacccgcacctctatcagatatgagtggtgtctctctcacctgatcgggcaggtaatataattgccctcaatttgtgattgcttcttcaaagctaatgccaggcttttatcagaattggtctaggatatgctgtgaaccatctgtgtgaccttggatgagtcacttcctctctctggacttcagtttttctcctatgtaaaataaatagagctgctgatgtctaatgtatttttgtgggggaggggactcatgtgatattagtagcaaccactgtagagtgtccaaagctctttttaagcacatatgtagtcaaggcaggtttcttatggtcaggagtagaattagagccattggttgagagtggattctagaatcagaggttctgttgctcttagatgctgggcatgctctgatttgatttttccttttccatgctgcttgtgcctaatggccctaagctccccactgctaagtgaaggaccagccttggactcccatctatgaatgatgagtgggcaatagtgggaagaactatacagggagtgtagttgtcaatccaatgaagcctttccaggacattccgtccagtaggattccaggggtcagtgcaggatgattgcatggctctattatggcctagataatagttgcccttggagataacccgggagagcctggattagtttagacacaaacttcctctaggtgaaaggatgccttcactggtggttggctgtaggcttaatgtcaccagggatctctcctctgcagtcaggcatcctaacccttaacgcttggcatctgtcaactttcctaaagccaatgggttttataccaaggttcatgcgtgttgaccagccagacatttctgtccccacaggattgaaaaaggaacataaaacacactcatgcacaaactgagggctgatgcgtaaaacagtcctggattcctcactttcctccaaaagaggttagctaagctgccctgtgatcctgcatgaccttgtggttcctgtgggcaatgctctttatcaaagacctaaaacacttaattgttcctactggaaaactgagatctaaatcttcatcagttttgccctgatttctttttcttattgcctaaaaaaatgaccaaaacaaaaatgtatgaagtagataagaaaattcacaggtaatccctaagataaccaacaccattagtttaaggtacatcttcttagacttttttatttgtagaagcagatgtatttttcatatttttatttattcaaaattgtattacatgttccacatcattaaaaagtctttgtaagcatgattttaataaataaataatattttctaaaatagataaatcataatttgcttaactatttctttaatggtggttgatatggtttggctctatgtccccaccccaatctcacattgaattgcaatcctatatgttggaggaggggcctagtgggaggtgactggatcatggagctgacttcccccttgctgttctcatgatagtgtgtgagttcttatgagatctggttttttaaaagtatgtaacactctcccgttcacactttgtctcctgccagccatgtgaatttttgcctgcttccacttcactttctgccactattgtaagtttcctgaggcctcctcagaagcattagcctgtacagcctgcaaaactatgagcttattaaacctcttttctttataaattacccagtctcaggtatgtctttatagcagtgtgagaacagaattatacagggataatttaccctaaattgtttcaagtatttttcttttgttttattcattatgatgtgtgttgtcaaattaactcaccaacttttaaaaaaatgtatacttctaccagcaatgtatgagactactcagctcacaatacaccattattatcattttgctatcatagatgaagatcattattacctcattattattttaatttgaaattcttgataaccatcaggttggatatttaccatttgtattttctcatttagaattgttctgtttgtgtcatttgcacattaatcaattaggatcttaatgtttttgttttgcatatttgtttgtttttggtatttgttctttgcttataatctttgtggcagatacagtttttagtttattttcttttaatattgcatataattttttggcatgcaattcaatccattaatattttcctttgtaattcctttgcttttatatttggaaagcctttccctgcaagaagtaaaatatgcctttatccatactttcttcttcctcattatttgattttttaatataaagttttttgatttatagcaagtagatttaagtgtaggatctaaattgattttcttccatatagttaaccaattgttccagtgttgattttaaaataattcgttccttccttactgatttgtgatgcttcctttaacttctattaaggtttgcttctgggctatttattcttttctgctgatctctgttaggggtaatattgagacaattagatagttattaggtcaagggatataaaaacacattgatcttaccttagcctaactatcttctttcctcacaagatgcctaaggaaggtatatattcaagggacatgcaaatcaaggtaaattttattatttagttaaggtagggctctatattttatgtggctgttccagttatctcttgttatatggttgcatagcaaaccacttgaacttagaggtataaatcagccattttattatgcccatggattatatgggtctggaatttgaaaagggtacagtgaaaatgtcttgtttctgttccacagagtctgaggaagactcagtagctgggggtgacttaatggctgggggatgggtgaaagacgtttcaaactctgtctcctggtcagcagtagctatcagctgggacctcagctggggctgtcagccagaatacctgtatgaggtctctgcatgtggcttcttgggcttcatcacaacatggtggcaggattccaagagtaagggtgccaggagaaccaggtagaaggtttactaccctttatatgttacctcagtagctatgtagaataactctgccacggtcacaagtctgtccagatttaagataagggaacatcaaccccacctcctgatggaaggaatgtcaaagtcccattacaaggaaaacgtgtgggatgggagacatttttgtagccgtctttggaggaaggtatgatttgttagagtgaggaaatttggcaagctggattagagcataaggcttagactatttgtcctgcttgatgttctcttcccctcccctagatatctatatagctcactgcctcactaaccaccttctcagtgaggtctctcctgaccgaccactctatttaaatttgaccttacacacactctgaaactctttattgctcttccttgctttgtttttttcttcaattacacttatcatctcacatgcaatatagttgtccagtttattatgatattatttactgcctgtctttcccctgtagaatattatcttcacaagtgcagaatctttgtctgttctgttcatggatgtctcccaagtgcctacaatgtgactaatacatagtaggtgctcaaaataattgaacaaataaatgactgaatgaagggcaggagccccttattccactccttctcttggccacctcccatcttgaggtgcctttggaaggccagagagaaaaccagaccatcttctctccttccttttccttttcctacctccttgccttccagctccaactctacagcctttctgctcatcactacctctttcgtggccagcctttgctctgctgtagccaaagtagggcatgatctcaaggctttgagcttcccagattacacacacctgttcctgccaccttgctctccacccgattatgcagggtccatgtcttctgtatgtaaccttccaatggaaatgaggtcactgctgtctgagcagctgcccactcctcccatccccaactgtgtctgtagtcatcttgctgcagcacacccctcactcaagcaaagcaaggagacttgatcctcagaacaaccctgagaagcatgaaggtcaaatataggggatcccatttgcagatgaggaaactgaagaaccacatagtcagcttgctgaggtcataaagaatggctgctggaacaagggtgctcaagcttggaatccatgaatctccattgaaatgtcacagtccccttctgaaagtggtggctgcattaccttgtggctctgggccccttctcagtatctttgggcttccatttcctcataaaggaatttaaaacacatcccaagttatgaggcagttgtaagatcttaaattgtcagagacaaaacggtcttgttgcaactcacgaatctgttgaataccatgaacacagcaataaaatggctgaatatccttttgggacaagtgaaccttgtcgtttgatcaaattgcctcccagaaataccattttgactatttttaatacagaagcaacatactgagcaaatgactattttggttatggttcttctactctcgctaccttcgccctggagaacatttagacaatctcttaatgttttttgttttttgtttttgtaaggactaaacttccttaaagggacatgaggagacaaaaataactttattttgccatctttgacatgctcacttgagctctgggccttgataaaatggggactgttttctagaaggtttcttttaaatctaacattctactgttgtgccgtggagtgtcttgcagaatctggaggggctggaggctttctttatgtaaatatattaatccttccacccaccccagaagttggcatccagggccagctagataataaattatgcccttcaattattgaaccagtgtatgtatttcagccaaaaggttaaaactggcttgtttgtaagtggcgaaaaggaccagccataacacacagttctgattctggtgcacaccactgtctgtgaaccacagattatagggagggaaccgagaggcccaggagccttgcccacaaggctgatgcagaattgtggagtttccaacaggtgacttgtgctccatgtggctcattttcaataggcctttaagaattttctttcagactcttctctgtttcagtatctctcaacccctttaattacgaagttcttttcatctttaactttaattcttccttatgtatgttctcatcagtcactgccagtctctggtaaatctgcatatcacagagatcagcctggggctgatatagctcctaagtatagcctgtaaatggaactggagtttaggctccttattaccatagaaattaaaaaactcttccattcacgtgtagtttgggttcttagacagggtccgctaaacccgccagctcttagtgggctgtagaggctttgtgcttgccccatgctgagctggaaccatgctctgaagggcatcagatgctaccagctccctcttctctgagcattgcgtgtcgagttgcaccatgctgctgtgcaaacatggatgggctgactgcccttcctttcaattcagttaataaattcagtgggagtgagttcagttcctgagatgtgctagagatgagaaaggatgtggcagaagaagtacctatctcttgagggatgaagtggcctcatttcacctactgagagtcaggaagtgccccatctgcagcctctgggctggttggggtcagtctgcagattttccttgctttctcccatgcccttgtctttctctcccctgtagagaaagacactgatgttgctgttgttctaggaacagtggggacaactgttaggttagttaaaaacaaaaacaaaaaacactgaagaatcaactcccttcaagcatgggctagatgctgaagataacatactgcccctatccccagagacccttgctcccagcgacccttggtgtctgggagagagaccttgggcatctggagacctggtttcaagtcctgactcctgtcttactggcaatatgattttggacaataaaagccatatcaataacaataataagtacttctgttttggagtgctaactatgtgtcaggcagaatgttaggtgacttcccacattacctatttgagtaaacttatcttttcaactttcagtttccttgtactaaacagactttgtcagcctagctcttcctccaacacaatccccaaccgcatacccctgtggacatggtccactgatctaagaatggatttctgagcaaagatggaccaatagttcttcaccctagactttgggggcaggactgagttgtgttgggagagagagaaggagaatgtgtatccatgagtgtctggatgtgcagattgttacatataaaactcaggagcagctgaaaggcaaaagaagccaatccacataggagaaacaaataaagctgattggcagaatggtgaagacaaaagaagggctcagggtcctgagggctcctcaggctcaggcttcagtgtgctctggggacccagctccttgcctgttcttgggctctgtgggacagcctatgtcctagcaaaatctttcctccttagctggagctagtaggaattaggtttctagtcactgtgataaaaatcctaaacacatttcttttgtgaaaagtggggaagttgcacaatagcagtcccatggaggacacatgcccagagcaggtcacctgacgtggcaagaagatcatggcaatgttgggaagactttgttgaaccagaacaccccaaccataagctctgctaatttaactgttggcagcagagttctgctttaggctgataggagcaaaagcccattgaactcagtagcatcaggccagaaagtggctgagaggtcttggctgacatctctgacacctctgatggatatcagccctgcttgatctccagtgcccttcaggggagagggtgggaggcgtttgtcatcacaatgtgacttgcatgtctaactgctagttctatacatgtctggtctaggaaaaacactcccagttctccaaacatgggatgtgtctttgcagactgcagactctcccatcattagaggcaccctgggactggaggttcttttgggcatgtgtggagtgatctttttctcccattcaatagatttaactcttctcttttctttcctttgtcttctctttccccatgattacatgagacaatatgtatgaagaaatactatgcaaatacattaacttacccatcatttgtttatttgacaaatgtttgttgactatgtgccagacactgtattaggatttatcaacacagttgtaaaagagaaagatgtgattcttggtatcatggaacatgcattcaaagggtagaaggagacaaaaacactaagtagaaaagtaaaagcaaaaattgtatgttgtggtgagtgctgtaaaggaaataagcaagtgacagaaagagaaagggcctacttaggaaggccaggagtactgctctgccaagactcaaaagagaggaggaagctgaccattcaaaagaagagtatttcagacatgagaagtggtttgggcaaagacccgaggcaggataaactggctgtgttcaagacagggaatagactgctgtgactgccctgtgacaagtaaagggaggggtatgtgtacgtagccagggacaagagcacagaccctggagtcagacagttctggattgaatcccagctctgcccaggtactagctggatgatctcagacaagcaggtaaccactctgtgcctcagttttctagtctgaaaaatggggacaatagtacttatattttgggttatcataattatgaaataagataaagcattatgttagtccaaatcctctgagaagcaggtgtcaagataggattagatgcacgacaggctgttgggagaaatgtcttgagggataaaagaggagaagccagaaaatgtgggaaagccttcagacctcaatgcaggtctgacttatgaaagagtaggggaaggttaataatactgcaatcaacatgggagtgcagatatctctttgacgtactgatttcgtttcccttgagtaaatgcccagtagtaggattgctggatcatatggtagatctatttttatatttttgaggaacccccatactaatttccataaatggctgtactaatctatattcttaccaacagtgtaagggtttcctttccttcacatcctcagcaacacttgttatttatttatttattttttgataatagccattcaaacaggcatggggtgatatctcattgtggttttagtttgtgtttccctgacggttagtggatgtgagcatttaaaaaaaaatattcttattggccatttgtatatcttcttttgagaaataccttttcaggtcatttgctcatttttaaattgggtcattttcttactattaagttgtttgagtactttatacgttttggacattaaccactttatacatgtatggtttgcaagtattttctctcaatccacaggctgtctcttcactgtgttgattgtttctttcactgtgtagaagcagcttaactttttatttgatgccatctcttttgtctgtttttgcttttgttgcccatgctttggaagttatatccaagaaaacattgcccaaatgaatgtcaaaaagcttttcctctatgttttcttcttgtggttttacagtttcaggtcttacatttaagtcattaatccatttcaagttgatttttgtatatggggcgagataaagatccaatttattcttctgcgtatggatacccagttttcccaatgctctttcttagacagactatccttttcctcattgtatgttcttggtacctttgtcaaagatcaattaactggaaatgtgtggatttatttctgggctctcttgctgttccattgctctatacatctgtttttgtgccagtatgatgttttgattactaaagcttagtagtgcattttaaaatcaggtagtgtgatgcccccagtttttttttttctcaagattgctttggctattctgggtcttttctggttctatatgaattttaggattgctttctctatgtctgtgaaaaaatgtcattggaattttgataggggttgcattgaatctgtagatcactttgggtagtacagacattttaagaagacattcttctaatccatgaatacaggatattttaaaatttatttgtgttttatttaatttctttcatcaatgttttataattttcagtgttcagatctttcacatttttggttaaatttatttgtaggttttttaatgctatcataatagggactttttcagatagttcattattagtatatagaaatgctcctgaattttgtatgatgatttcatatgatgaaactttattgaatttgtttattatttctaacagttcgttggtggaatctttagggttttcatatgtcagatgatgtcatctgcaacagtgtcaatttaacttatttttttcctgttcagaccctttcccttccctttctttcacttcccttgcctttctgtttttgcctaaatgctctggctaggacttccagtactacattgaatagaaatggtcagagtaggcatcttgtcttgttcctgatcttaaaggaaaaacgttcaacttttcaccattgagtatgatattggctatgggcttgttataaatagcttttattgtgttgaggtacattccttctataatttgctgaggatttttatcattaaaggatgttgaattttgtcagttgtggattttgcatttattgatataatcgtatgatttttgtcctttattcttttaatgtggtgtatcatattgattgatttgtgtattttgagccatccttgcatccgagggattaatcccacttgatcgtggtgaatgatcttttaatatgccattgaattcattttgctagtattttgttgaggatttttgcatctgtgttcaaggatattggcttgcaattttcttttcttgtagtatccttgtctggcttcagtatcagggtaattttgcctcataaagtgagtttggaagtattccttcctcttcaatttatttggaagagtttgaaaaggattagtataagctcttctttaaatgcttggtagaattcaaccatgaaaccctcaactcctgggcttttctttgatgggagatttttgattactgattcaatctttttactcattattaatctgttaagattttcaatttctttatcattcagtcttggtatgttgtatatttctaggaatttatccatttttcctagattattcaatttgttgctgtatgattgttgatagtaatctgttatgatcttttgtatttctgtggtattaattgtaattctcctctttcattttttattttatttgagtcttctcttttttcatagtaaagatctgttgattctgtttacctttttaaaataccaactcttagtttcattgatcttttctattgtttttcaagtatctgtttcatttatttctgttctgatatttgttattttcttccttctgctaacttcgggcttagtttgttcttctatttttagctccttgagatctgatgttagtttatttgagtgcttcctccttctccttaccctcctccttctttttgaggcaaggtcttgtgctgtcgctcaggctggagtgcaatggtacaattacaactcactgcagccttgacctcgtgggctcgagtgatcatcccaccgcagccccctgagtagctgggactacaggcacatgccaccatacccaaccactttttttatttttttgtagagatagggtcttactatgttgcccaggttggtctcgaactcctgggctcaagcaatccacctgccttggcctcccaaattactttcttcttttttaatgtagatatgtattgctataaacttaccttttataatcgcctttgctgcatctcataagttttggtatgttgtgttttaaattttgtctcaagatatttttaaatttcccttttgatttctctttgactcattggttgttcaggagcatgttgtgcatatttatgagttttctgaaatctctcctattattgatctctagtttcataccattgtggtcaaaaaagatacttgatgtgatttcagtcttcttaagtttgttaagacttgttttgtggcatagcatatgatctatcctggagaatgttttgtgtgcacttgagaagaatgtgtattctgctgctgttaggtggaatattctgtgtatgtctgttagatccatttggtctaaagtcttagtttgtgtccagtgtttccttattgattttctgcctgtgtaatccaagaaatcttgataattgctattggtatcttgtttttgttttcctaatttcttttctgtttttttttttttttctccctttccttaactaatccttagttagctacaggacctcaggacattacccatcctcatagttgagcaagagacttcctaacaagagctaacgtaggcagttgccatatggtaggatttgagaggtaccacaaaaattgccctttcttaaacaaacaaaccaataatcccatacctgtgatactaccagaagttccatcgttaagaatttcttcccctgggataagcctcagaccacagcttccaaggggaacattttaaggccctagccatgtaggtctttgtgtgtcttatttggaagcactcaatgttgcttaaccctaccctcttgaaattctccccttccctctcatgggccactgctgttctgattcttgtttcaaccttcctccctttccttttgtccatgtctgtattctttgctgactcctttctcccatcctttgggaaccccaaggctctactaacaccctttcccttataaatctactatgacttcaaccaggaacatgattgtcaatcaatatgtcaaattttcacatcttccgagcctcatagcacatctctcaactttgctttggtcatttcctcctagaagaagtctttccagtaactcagtccctatgtgaccaaaccgtcttctcctcccctgacatccttcctctgggtttcctgttcacgcaggctggaaatctatgacacatgtgtgatgttttccctctttcccctccaattccaatcactcctgattttttctatttattttttttcacaagcgaccccctttctctgccattaccttcactcaggttttcttcttccacctgcggttttgccgtggcccactcactatacttctcattgcctcccctgatccctccattttttggaactgtctgttgaatatttaatacatatgggtgaagtctaagtagttttgaaagttcttgagcatggtttgttctcagcagttttggcatcccatagttttctttacacgtgccacttgtgcctgagtctggcttcaagggagagcggaggacagcttcagctgtaagcctctctttcatgcctggcctgactcccatcccagacctgacctcctgctgaacaactgctgcctgagccttaccttgcagacacagcaacttcttgccactagtgtcacctagagagggttcctatccccagtacataacccttccagtgggacaaatccaattcctagccccagcccctcgtattttatcctgccccacccactcaagttgttaaatcaaagtggccgtttcctgagaatgtctggaagatcaactgggtcagaacttttgtttttgtttgtttgtttgtttgttttttgagacagagtcttgctctgttgctcaggctggagtgcagtgatgtaatcctggctcactgcaacctccacctcctcggttcaagcaattctcctgcctcagcctcctgagtagctgggactacaggcacgtgtgcctggctaatttttgtatttttagtagataccaggtttcaccatgttggccaggctggtctcgaattcctgacctcaggtgatctgcccgcctcagcctcccaaagtgctgggattacaggcatgaaccacagcacctgaccttgtttttgtttttgagatggagtcttgctctgtcgcccaggctggagtgcagtgaggcaatcttggctcactgcatcctccaccttctgggttcaagcaagtctcctgcctcagcctctggcatagctgggactacaggtgtgcgccaccacgagcggctaatttttttttttttttgtatttttagtagagacggagtttcgccacgttggtcagtctggtcttgaactcctgacctcagatgatcctcttgatttgacctcccaaagtgctgggattatagacatgagccaccgcacccggcctcagaccttttgtccatgtaacctcctgtcagagcataggagatgctgtgcgagaggggggtggttccacttttgtgtctcagttatcaccctaagggatgttcctcatgcttaattatgtgctattattcatataatgttagagtgcctacggttccatttatgtaacattattaaaatgacaagattatagaagtggagattagtggttactgggtgttagggattaaggcaggaagaaggtaggtgtggttatacaggggcaacaggagggattcttgtggtgacggaactgttctgaatcctgactgtggtgatggatacagaaactaatgcgtgtgataaaattgcatagaactaagcataccacatgcatacacacacacacacatgcacacacacatacacaccaatgcaagtaaaactaggggaatctgaataaggttgttggattgtatcaatgtcagtatcctggttatgctattgcactaaagttacgaagatgttaccattggcagaaactgagtaaaacggacaccacaggatcactctgctatttctcacaactgcatgtgagtctacacttgcctcaagataaaaagtttaacaaaagaactagcacttctagccctaacacttgcctagtggtatttgttgaactgaactgttcattctttcagccagttctatctcttgggaataatagatttcatgggacttttgttcatttaacgagagtatgtttctactcactctccagaatgtactgctagcttcagcttctccagcttcctctttattcttacatgcatgattttgttgacatcggtcataccacccttcatgctcttgcctatggactagagaatcccactaactttagtccagcctcaatgctcctttgattgtttaaactgctcttctcccgcccgtcacctgtgcccatgggatcagagccacattcagccttagccaagggtgactacactattatatgccacagtcaaagctggatcatctcattggtttgtattttcccttttttttctttccaacatttttggccactgaaacatattaactggaatcccctggggtccagtctgggaaagactcccagatgaattccctgagttttaattgagaactcagctctctgaatcttttaagttgcagaactatcctctacttttctacctttctctgcccattcacatagtcttgtaggatcttaagattccttcccatcaacctcccaattttatactaaaaaaacttagtgtcacctgccaaatctgaaagtgtactgcacatttcatgatctaggttatttataaacaaggtgcataaattcgagcccagttctaactccacagacatgcacattcgcctcctccggatgtttcctgcctttaggccagagtcctatatttgctaaatcccacccccgtggtcctgtacacgacacacacacttacacacagacaactaaggacacttggctaaaaggtacaactgagaacggtgcctattacagaatcctattacagaatcctagaggcgggagaaactgcgaggtcatccaattcagcgccctgtctaactcaggaacttcatttgttagggattctttcttagcatgagtccacagttgtttgtcctctggaaggacacaggatccgtttcttttctccttcacccatgttgcttctccactaattgaaactctgtttcctgggtgatgcacccactcatcccttcagtcattttgtgcacatcgtaggcagacagaggatggcaccacttgacccacttctggtctaagaggaggtaggatttggtgaaagcagcctgttggtggagttacatagacctgggttccaatatctattcctgcacctcctaactgcacaacctcgagcaaattactaactcagcctcagacttattttcctcatatgtaaaacttgtctcaaaggttgaagtgagaaatgactgaggtcgtgtttgtaaaatacctggtacacattagctgctttcactatgatagcttatattacaggtagtagttcgggtaattttactgaacacttactttgtgctgatactacatcaggcacttcccatgcagtaatcatttttattcttcacaatgactctaaaataaagatgctgttattatttctcactttacagatgagagagctagggccctgttaagtcatttgtccgaggccacaaaactgtaaagcaagagagctaaaattcaaccccaagttttttctgaaacttagagttatgagtcgtctgacaactctgtgtcattttttttacttcctccctcagagaacctcaatacattaatcaggcagtcacctcacatctttcttaagaagagacaacgtatcagtacacagaatatgcatatttcatctgcaaggcatcatagtactgctcgctctatgtttatgtaattatcatgaattttaaattaatgtcatctgaattaatgaggtcacacattaaagaaacaaaacgtgatctttaggatacttctggctttaaaatttgatgattctatagacatagcaaattatagggaaataaacaactaaataattgaagaaatgggaagactacacgtggctggttttgaccaagattttcaggattttcagaacctgaaagccatgggcttatggagacaaaatgggcaaggtctccgtctgtccaaccttctctgaccttgtggctctaacacaagaaccgggacatagaaattcctgtgttcacttctttgagggaggcacagagacttttgtcagtgtgttgattcctattaattaatttttaggaactcttctgttaatttttcccaaagttcaagggtataatccttgaatgttgaccaattaattaaaggttatgtataggcctattaatcaaggttctcatctttacattttcatatccccaggggtgtgaggtagtgatctcttggtagaaggaagaaggggctaactgttcctgtgtcacccccaagaaatgagcatggcactgcataaagagatgagttacttgtgcatcagggtggcagccctgtacagtgggaatagcatgggcccaagattcattctgactcagatgtaagtctcttaacctaagagccttggtgtatccaactatagaaaggaaaaaataataataatattgccatagggaggctgtgaagattaaatgagataatgtatgtgaaatgccagggtgctagcttgttcctttatggcttcattcaataaatattgattgagtccttctgtatgccaggtccatgccatgcaccagaattacaattggtgacattgtaagacagacatcgtccctgccctcatgtagcacacagtctaatggaaaaggcagaccagaaaaaagtcacagatacaattctgtattgtgcacttaaaatttgtcaagagggtaaatttcaagaaaaagaaagagagggtagatctcatgttaagtgctcttaccgcaataaaataaagacataaataaatgagctagtatatttaactacaaaagaaagtatgcacgcacatcaatgaatttatattggtaaagtatttagaacattgctggttacagaggaagtgctatggaagtatatttttaataaaaaatatattcaatcattagggctttattataaggccataattatgggatgtggaaagatttaattgcaaagatccttcaccccaggatggttaatagaaagttggaaacaaccttaaagtccaacagtggatgatgaactacattagtgcattttgtgttgctgcaaagaaagacccaaggctgggtaactggtaaataaaagtttattttggcttatagttttgcagactgtacaggaagcagggtgtcagcatctgcttctggtgaggcctcaggaagcctcagcctacaatcatggtagaaggcaaagggggagccagcatatcatgtggtaaaagagggagctcttaagagagagagagggggaggttccaggctcctttaaacaaccagctcttgtgtgaactaacagtgagacacgagggattcaccttcataaccaaaacacttcccagcaggccccatctccagcattggggatcacatttcaacatgagatttggaggggacaaacatccaaatgatatcattgcctaaataaattatattaatccatatacaaatagaatacagggaacgttaacgtagctagtgtgatagcgaaggcctccttgaggaggtgacaacatgatcaatgacgtgcgagaaagacccatcctgtgcagggtggaggaggacaggataagaaagaacattccggccgggtgcggtggctcaaacccataatcccagctactcgggaggctgaggcagaagaatcacttgaatccaggaggtgaaggttgtagcgagcccagatcgtgccactgcactccagcctgggtgacagagtgagactctgtctcaggaaaaaaaaaaagaaaagaaaagaaagaaaactttcttgtcagagggaacagtaaatcccaaagccaggaggtggggagggacgtggcaaatctgaatgaagaatgaacccccaagtgaagagagaagaggagggagggagaggagaggagggagaggtatgggaggctggggagcccagcaagggctgaccctgcaaagtctcctgggccatctgagtgacgttagattttattgcaagtgcaacagaaagtctttgatgaggtttgagttggcagatggcatgatctgaattaagtgttaagaagactgcatggagagtggtaggtagggagagcagaggtgggaggcaggaaggaagctggttgagaggctgccgtagaagaccagatgagcaatgaaggtggcggaactgggtggtagaagtggggagagcaaggtgtggggggcctgggatcttgtctggaggtggcatgaacagacttgctgagagattggatgtccagtctgtccaggtgagagaaggtgaagaactaaggatgcaaagcctggattttggttgagtaactggaaaaatcaaggtgtcatttactaaaatgggtaagactggtgtggggagagaaacacagggttaggctttgggcatgttgcatttgagatgtctgtgaaatatccaaatggcaagatcaaacaggctgtgcagaagctggggagtggagagataaaaataaaagttgtcaaccatattgatgatgtttaaagcctaaatcaataaggctgctttcgattcccatatattaataataacagcaactgctagtttatgagttttctctgtcttattctttggttatagctgttatcttagtcattttgggttgctataacaaaataccatagactgtgtaccctaaacaaccacatctatttctcacagtcctggatactgagaagtccaaaaccaaggtgttgactgatacagtgtccaccagtgatggctgcttcctacttagcagatggctgtcttctggttgtatcttcacatggtagagagcagagagagagagagagagagagagagagagagagagagaaagctctggtcttttcatccctttctaagggcactaatcccattcatgagggctccaccctgatgacctaatcacctcccaaaggtctcacttccaaataccatcacactggggatttaggcttcagcatataaattttgggggtacacaaacattcggtccataggagttgtcaggcatacccattagattgtgtaccatcaggagtagttgtaactaagtgacctaggagagggggaataggtgtggaggaaggttccagaactgttggaatcctctgctgggcaggctgcttatccaattccaaccactgcagctgggattgagagatctgtctcatggcatggaggggcccttccccacacctttgaaagtatagtcagcaactgtcttacttgtaggtctggctggtgtggcccatcttggtaggtaatggtgagtggggctgctagtctgttttttgagtctgaaggggttaaggagggccacacagatttcattgcagaacagatggctcacagcctctgcacttatacctcccattgtctgctgtctgattgtcacctgggggaaggctgccatgccatgaaaatgtaagaagttgcaagctttattagtccatcaccaccttacctaccttagcatagcctcttccaaggaaacaaactctgtgccacaggtcattggataaacgctacataggggcttcgtttcttattcctgtgctggcatctaagggaacggaagagaaaaatcgatgagtttttgttccgttctctatcttcccctgcaggcagatatggccagaacagagtaataatatgaagaaacttttctttggctgcacataagaaaatacaggttctacctctcattctactacttactgctgctgaccttcttttggccagtcccttggacattctgcatcttggctggtccatctgtaaagaaggagcagtctatgcctgctctaccctctcccagagctgttttaagcagcaaaagagaccacaggtgtgaaggtgctttggtaacaacagagtcgtagaaatggggatttgtttgcatgtattccgccaggcccctgttctcatggaagtgtgtctggtgaggaagatgaataaggcgagctgcttggtctagacagtggtccttaaagtgtggttcccagaccagcagcagcaatacttgggagctggacagaaacacagacttccaggccccaccctagacttactgagcccaaaagccctccaggagtgcctgattcctacctaagcttgagaacaactggtctaggcattcaggaaagcacttcctgagaaaatgactttaataaaatctgagaaataatcagctcttagacagaccaagaggaagggaatgcgagattcagaacaccatcccagaggaaggtcttggcgcaagagacagcttcatctttttgagaaattgaaatgagtccagtgtggtaggagccaaggaagagcaagtgtagaaggcaatgaaaggaagcagccagctgtgaggggccttgtaaaccggggaaaagattttgcagtttatgctctggtcaattgaaagccattaaggggtttggagcagagaagggccttttctgtcaataacatgctattgtaattttaaaacatttccttacaatccaataagggcagttaattgtcttaattagagcttacactctaattcgggagaaggcacaatgcaactattggggaagtctttgaatatatatattaaacacaaattatgtgtttggcactgtgctaggcactatgaaggaggcagaaagttacgcaactcctttcaggggattgagaagctgggtgagaggacaagacaaaggcgcacacaccggcaccggtgaagggtgccaggcatctccaggttaagtcccccgggggcagggctggttgtggcagtggcttagagggtgggtagctaaagaagtgttggggcagccagaccaggcttcctggacgaggaaagggcttgggagaaagcacaggggcagagatgagcaaaggatttctctgtattcccggggaacagttcccttgggaagtactacaaaatacactgggaggcacagctgagaccagatggtacaaccaagtctagggagaggaaacacccccgagcctggctgcatagaccccagactatcttgaccccaaatgaagctatccttgaggttgtggccaaggtcccttttgggaggcctcatgcaagggattgaggcctttttctgcagttgccaatgagaattccctgttcagtctctttatcaggctctggggcatccctgagagttgctggctttgcccttgtttttaaacctttttatagaagtataacaatcatagaaaaaattacataaaccttaagtgcatagcacaaagaatttttttcaaatgaacacacctatgttccccctgcctccccacatcatgatcaagaaacaggacattcccagcacccggaagtgcccccgcctctgccattcctcatctggcactgccctccctgcagggaaccagtcccgacttctaacttgctgctttttgtcttctatgggctctttggtttctagcttcccagcgtgatgtttgtgagctatgtccacagtgttgcctgtagttgtagattgattcatcctcattgctgtgtgatattccatcaggtgacgtgtatacactgccattgatttgtcttgttctactgtcaatgggcattttggtagtttgcagtttggggctatcattttgttgcattttaaactttgacctgggtcttccttttcagtttgctcagattccccttattgtcactaatttcctctcctctaaaactgttgtactctgttgtatgtgtgtttgacaatggaaacaaataaaaaaagaatactaaatgaaaaattggcaccacgagattggagggatgaggggggagggcactaccagagagccacctctctcctccctcctcccctctcctctccccttcttcccctgcttcctccccactcctcttcttcctcagagggcctaagctaagggacaccactgcaaccaggtgctgacagccaggtaccagcaaaactggccaaggtagattgccctccagagcctgtgaagggcaggaaatgtatcttgttcatttttaaagatggcttggtgtggacacttggtaaatgtttcttgaatgaatgagtttctgatataataaagtgtctgtgtttcctgttaatctatgaggtgccacgtaggccctgagaatacagtggggtgtgacatcctccccttgaggatcttctgaaacacatttggccgagcacttaggccaacatcaggcaccatctcagcatgttccgcctcctgcctcctgtaattctgccacagctctgtgggtagtccctcttcttaccacatgcacaggtggggaagttgaggcacagctgcctgagtggtgtcccaggtttatacagttagtcaggggacattcaaagccaggggtgggcttgaatttgtgctctaactgccactgtgacacttgaatactgccaagtgagcatagctaaacagaagggacagcagacagtgagcggtccccagagcagctggtggggaagcccagcttttctgaggaggaggggcccgagtggggccctcaggaaggtgatgcttagagaggtgggaagagcaggcgggtcctgtgagatggggggcagctcgaggacgctcctggtgtgcatggagatgtgtaagtcagaaggtcagggacactgccaagggcaggtgagactatggggaggggagaggtgtctctgggctgtcctgggaacacaaaccctaggagtacattgtggccaatcagtccacgtagagctgcctgaatcaatatttcgcactctagaatctgcagctttgctgctgttggggtccctcgtggccgcatctctgcagtcctgacttgtgcattctatgtgagctcaactttcctccccagccggtctcctaagtcagcttctgccaacagcccgcaggatatgtgctcaagaccttcacctagccttcagagcgacatagcccccacctcaccctcctggcacccattccagaatttagccacaggaagctcagagctgagacctgctggaagcctctccctttccacaaaccagagagcctacccctctttccatcctgggtaaccctcaacaatacacaaattcattaacatttattaaggttttacaggctaggtattaaaacactatgcgaaaagccctgcaggctagcagaaacactttagaattctctacttatccagcagtttggtaattaccttgaaggtggtatggttagaaagcacatatctgcatacacatgttcatttccttccttcctttaagtctagctcagtggttctcaaacttgctagtttaaaaaaaaaaaaaaagccttcctgaacaaggtggtcagcatgaaacatgcaggctgcatgttctgggggaatttaagggattttcaaggatagttttgaatctatgcaattcaaaatatcaatttttgcctttcgcactgacatcagaattgaagtcccactgtactgcttaggtggttgggaagaaaagcctccccacttcctcctcccagaggcactaagacctattcacacccgctgcccctgatcccccagggaccctggcagctgcgtaccgagcctcaccagcagccaagagagcactttttggatacttggaaatccctgccacttatggggggatttaagtccagctggctccctagctgggcctattttttggagccagaagtttgtctcgccactagacaatgagcgtatcaaagctgagactctttcccatctctgcttctccttcttacacctcccccaccctcatcctcctctccttcctcctttgcttcatcttccctctccttcttgtcctcttcctacgctctctcatttctcttctcctttctctctttttttaccccttcccctgccaatgttttcatcattgagcacagtgcctgtcatggaacaccattctataaagtttataaacgaatgaatgaatgaatgaatgccattctttggcttcagaggaaaatccacctattttcccgttcttttttcaatctagggctcttggaactagattgtcatgttcacctttctgtctttttcattattccctgaaagcacaaactcaatttaggctttagtgaaaaatgaagagcattagaccaaccttttaaaattgcttggtcagtacttcctgcttgtctgtacttcacaacgctgtcatcacggggtaattataacattaagtatgtacctgatcagcaagttgcttttattaaaatcccctgttggtttctaggcatctcatagctcctggggcatttgttcaactccttgggcctcaggcagtttcatctccagtgcagataggagcccaggtccagaggtcctgggtcaacacgtccctaccaccaccctattccccgactttcctgatagtacttttgccaactgtgtggtgagcagctcattatggtcacctctagaagaaggggctgcctattcatagatgagaataccgaggtatcgtggagggaagggaggagcccctgggaacacggcttctcttggcaatccctaaaccacatccaacccacagtgagattcctctctgtgtttttgctggtggaggccacctggacctcctttcacgtttccctgcaggggtgatggcaactgtggcagggccattttttactttacaagctcctttttacgtgtgtttacaaattctatagctcagcaagattctagttctggagtcagacagatctgcttataggtgcgggccaaataacctgactgttctgagctgtgttttctctgctgtaaaatgggaataataatagaacctatctcatagaatctctggtgagcatcaaaagatgtatgtaaaaggcttcacatagatcctggcacatggtaaacactcaacaagtgtggctaatatgataatagtagtgctacttagcagttatccagtaaggaagttgccagacttttgacaatctctggaggaggatggtattgctttcttgcagtttgaaaaatctttcaatgcccgggggaggaggtggactttggtacagcactgaccagagtctctaccaccaagtagactcctctgctttataaaagttataagcaagaactcattgagagcattcattcactcaagaaatgtttacatgcctgctgcgtgccaggctctagacaaggatcatcctagacaaggtcttgttctcatggagctaatattcttgaaaggaagacagacaataagtgtgtaaataaatggacaaggcaattttatatagtgatgagtattgtgaagaaaataaaacggggttctaggacagtaggaaatttggggaggggtgctgttgagttccagtggttaataaaggagccagtcagcgtgaactggctatgcggtcaggtgggggggcaagtgccaagggccagatcctagaaccagatcctagaaccagcgtggtgtgttcaagaaacagacaggagttcagggtaactggcctgggagaggccaattccaggtgagatcagagagattggcagggccagattatgagagcctgctgatcacagaacatcacactcccaagcccaaaaccagatttcttttttataaccatgggccagatgtatgggccacactatagcactatatgatatagaccagaccactggaaaaggcttccttcatgaggcaggatttagtatgaaccttggatgggaaataaagttgtgcattgtgctacagagaaccctggcatgaactggagcacagacactttttaagagtgctgtggagagtcacagttcccagaatctgtcttggagcaccagcacccaagaggtgctcctcaaccaaaggtttctgggagtcttccaaaagtttggggaaatggtaaactagattttattctccaaggttaaaaaatgtgtccgggcacagtggctcacacctgtcatcctagtacttttggaggctgaggcaggtggatcacctgaggtcaggagtttgaaaccagcctggccaacatggtgaaatcctgtctctactaaaaatacaaaattggccggtcatgatggcacatgcccgtactcccagctacttgggaggctgaggcaggagaatcgcttgaacctggggggtggaggttgcagtgagctgagatagtgccattgcactccagcatgggtgacacgagcaaaactctgtctcaaaaaaaaaaatgtcgttaaaggttgaggaagccttgcagcaaagacacctgtctcaccttttgtaatccaacatgtcccaagcttacttaaccgtgaaaccttatttatttacagagtccctattaacatcccccagaattaaagtgccagggaacaccctttgggaatcactgttgaagaagaagccagggtttgtgtgagcctgagggatcagtagcatctgtgattcagcacttgtgcccgtgataattcatggtgatgatcccctccagtgactcaaatcattgagtgtcaactgtgcctatgttagccctgatccacttgctttattttcattttgctagcaggacaagggagtgcctggagacaggaaatgagtaaactcacatccataaccccctgggactgggctgagactgggttggttatgaaaatgctcttgggccttagacgacagccccggaacccccagtgataagcttctcaaagagttgaggtccacagcctgtgaggagcctttctgtaggatgagcagtgtgtgtactgtgtgtgtgtgcctctgtgtgtgtgtgtgtgtgtgtgtgtgtgtgcaggggggttatcagggtgaaggtgattgcattctcagctcatctctgctgctagcaacatcaaacacatacttttaaacttttggctctaatttccctgctgatgacagtaaaccttagtttgtcagtcacttggatggatctgggttggttttcggctcatgaatcgtagaaatggaagtgacgtagtaagaaatcatccagtctccagtctcctcccctaagaaccaggacaatggttctaaccttcagaagattgtgaactcctttgggaatctaataacagctatggacctaaccccagagaaaaagcacaaatggagattcaagtaacatttcacctactatatcagaggtttacaggcctttttatgtccttggtaccccttatgtgtgatatggttaataactgttccttgaatacctatttaaatcctgttgttcattgtctcaccttgctcttaggataaggtaaaatattccctaaaatggcacacgaggtacatgatctgcacctgctccccactggccccggggggcactgctcattctctctgcccccatctgctgctggtctagccacgcaacagcacctctgagagttcttgctcttacccacccctgctttccacaaggcatatgcatgcgttgttttctttccctaaaatgtcttttttcctttgttgtccagacaactccttcttatccttcagatagcagttccggggtgacttcctcaaggaaatttccttcacctccttttccagaacttatacaacagatcatccattctatgccctttaccaagtcctatatgtcagattatccatcctgtattctcatagcactgtagacgtttctttcaaaagcgtatgtcacagttgaaatttacctctgtttttgagattaattaattaaggcctggcttcccccactagacagcaagtttcatgagggcaggtgctggatctttggtgcctaataatgtgctcagcatacagtaagtgctcagtagtaacttcgcgtagggtgagagtatgatcattgattatgaatgctccctatatatcaaagcaacccattccatggtcccagagattttgttctgttaacttctggttttgaaaagtgacaattttttgcttgcatccattttactgacaaattatgggaggttttgtcctttaagtaaatcaatgaccactttggtctttgcaaagctgttggccagggttctacaatagaaatccccttcaatgaattcagcgtcaggcagaacttggacatcactctgcccaccctcaggctgcaggagtatatgataaccatatccatcagcagccatccatatgatcacatttacatttctgtcctttcataattcctgccatcattcctgcctccctttcttcttttcttcctccttccttcttttcttccagcagttgcacaggtaccctcgcaacctaagtagagaatgtgacacacacgcacaccatacacacacaccacacacacaactcttggaggaaattttatgtgtatatgtgtgccccgtatgtgggagtaggtgtaaagtagggcaaaatttcactaccaataattctgattcatagttgaaattgactctgcatggtagtggggcaccgagaccccttctagctggtgggtcttttcccctcatccccattgatattcccctcctctccatgaacacaacctaatattggtattactgaagtctcaagccccaatatttttcttacccaatcacccttacctgctcactctgcccctgccatttggtccagctgcgttctggggacttcatacagtggggagaacctcacctcacaaggatgagaagctgtgggcattccctgttctcatttcctctgtcctttatgctagagcatttgctccaacctccacttcctttcagtatcctgccacagaaacatccgaggaagatgggaagcctatagtttcccacctgcaactcatttccccacctgcaagagaggaatgttggtggaaccaggtgctggaatggatgtttgcgcagccccaggagctcagtacacactactgttgttaggtctacacagtccaatgcaggcacatgacaaagctgctctgatagaaatgagccctgcctgctcagtcctttcttactatcctccatctccatgtggtccagtcccagcctgtggtccatgctatgggtcctggaggtaatcagctgtcactaaattgagaactgtccagagtcttcactgccccttaaccataactaacctgggaacttgagtgtttatccttggagagtgaagtggtaactgtgtggggtagttggtgagaaagttcattgtcaagtgggaagaagaacagacatgtgggatatagctgtgtgccctggtaaagcctgagaatgatggtcagtacagcccaagaacacccccagattcagattcttcgtccagttcttgctttttctgaagtgtgacggtggggcttttcttgtattccttccaataaatcccttgttacttgaagtcactcaaacaaatatctgttcgttgcaaccatgagaatctagccagaacctctcctcgggtctttcatagatataatatatattttttcttttttaggatggtcatagatgtatctgccatatttaacctatcacactacaggcttcttaaggcaggctctccttcaaagtcaactttctagcttctgatgaaaattggtttgaaaaaagagaaggagggaaggaaggaggggggaggatggagaaaaagagggagggagagaaggaaggagaggaagaaggtagaaaagaggagtgaagaggaggatggaggaaggaaaggagaagggaacgttagttttcaggagggacctgcatagcctatacgtcattacactgtgtaccatggctggggtaagagtggaggatgaggtaggtcaaaggcataagggtcaaggaacagttattggctaagttttccatgaagaagggtcagataaggccttgattcagaacagagagttttgtttttggataaactagtttcgatgggtatttttggaagatgaagaaatggaagtttatttcattgtcaattctgcccgtttcaatttggcaaacagatttcttcactcccctttgtgtttcagacagcactaaggctcttgttcattgtaactccccaggactcacggagcgcagcccccagcagaggctgcctgctattacccagaaggccaatagagggctcccaagaacactgagcaaaatttggtggaagacatcaagatgttcaactgtaatggcagtactggttattatccttctctaacatacaaactgataagactgtattcatatgataaaggtgcaaatggaagagcacctgccatgaatgcaatagaagcagttgctgcattaaggaaacttggattagattagctttaagtttctttctgaacacaagccagtgtcttgaccggaagtatctcttctagaattagctgatgatagagctttataaaacacttgcatgttggatatgttcaagacttgattctgttcactatgttatcttggaaaaaattgcttaatatctctaggcattattttgtcttttttttaaatgatgggggtaatgttagggtagtgggagtttggctttttaagaccttttaaggtaaaatcttctgttactataactgatagaaaccacattcagaaaaatctggccgaatatgatttattcaaagggagaagagttaatcctatcccctaacacaaggctaacaaaatgattcttagagtaatacttggagcggtgactgcagtgtttgatggccattgagttaagacagtatagtgagggtgaaaagataacagtagccgtatctaaaagacttagattgaaatcttgactttatttaatagcaaatcacttcaccaagtctcagttttcttaaatctgtaaaattgggataatccaaattgccttgtctactccaaagtgtgaaggtcagataagataatgcaatagaagtattttgcatactacaatgtgccatgtaaatgttcagttattaatagatgcaataacttaatgtttcaaattttagtgacacagtatgtgtgaaagtctgaaattctttctttcccgaattcaagatctcatatagccatactgcagccatagtttttctttgtaatctttcaacagaaaacacatttgaaaagagacatagaaagatttctgagatgcaaagggaaaggaattagattcatagattttagaacagaaaggaattcaagaaactaagcaaaaccagatgatttatagacaatattgagaatatgtttgaattactaactgttactagactgaagtgggaactgagctttgtctttatccatttattctttcatttcagttgcttgaagttctaggaatccacattttggaactgtggaaagaactagagtcttgcagtgggattatctatctctttatctctccaagcatttgtaggacatgtacctatttgccagataccacgttaaatgcaggaggcaatacaaagatgtacaagatattgccccttccctcaaggcacactgaatactctgcctgtcacatagtaagtgacttaaaagaaagagatagatttctgggtttgtttttgtttgttttaggatatatgagacatatatgtcaaggaggcggtataacgtagcagttaagaataaaagctatagatttagacagctttgcactgtaatctcagatttgctaagtagactagctttgtcttgagcaaataatttggcttctctaaacctgagtttcctcctctatgaattgtgttaatgctgcctaccttggagcatgactgtaaggattaaatgagctgatgtgtgtaaagtgctcagcactatgagtagtgtgtagtaaactcacaattattattatatcattatcattattacagagcgacacaacaccaagtcataatatatctcacagaagagacaccaagagccacagaaatccagagaagggagcactcagcaaaggctttgtggggaatgaccctggaccatttaaggataagagaattttctattggcagagataaagaaaaggtcattccagagaacgcagaagaagggacacaaacaaaggagggaagcaagagagaatgtgccaagggctgggaatggcgagacaaccattttgtcatgaacaaaaagcttgtgttgtgatcacttaatgtattcatcctgactctgaaatttccataaagataccttgccatgtctccctgtgtagaaaattgccgcaattatcctaatgctttgctggtctgaattggaaggcagttatgtgaaatcttgaagatgatgagatttgtttcctggaattctcagccactcattcttctaccagttttctctctcactgggtcctcccctctgccagtcatccggcatctctaggtacttaaaaaaacttactcatctttcttattatataaataatatttgtttattgaagggagattagaacacgcaagaaaatctatctcctgtgacccccatggaatttgacccagccatctcctcaaaaacacattcttagaaaagaaacagataaactaatttgcactaaggtggaaatggttttcaatgggaccaatttaagagccctttgcagactaccaggcctagaacttcagaatatataaataattatcagtgtaactttaggcatcagaaagcatatagggaagtcattttgggtggtaaaagtgatgccagtatctacttaaaacattaaagtatattatacataagctgttgggttgtgccttttaaataacttttaaacatttttattcaaaaataatttaaataatttatataccatgaaaacacttatcttttgtgtccagtaggatgagttttgacaactgcatgcacctgcataaccctcttccctattgagatatataatatttctatcatcacagaaaggttcctcatgccccttgccagtaatctcctctacagaggcaaacactgttattcatttttcacccacaggttccttttgtctgttctagaacttcatatatgtgaaatggcacagatgtacttttgcatgtctggcttcttccacttatcataatatctgaaagatacatacacattgttgactcgatcagtggtttgttcctttttatttatagtattctattgtatggttattccattagtttgtgcattctcctgttgatggacatctggattatttccagtttgtagctattatgaatagagttgctataaacatttttatacaaatcttttatctttctatcattagtttttaacaatttgattatgatgtgccctggtagagccatcattgtatttatcatgtgtgggtttcattgagcttcttagatctgtagatttgtatttttcatcaaatttggggaaaataatcaacactattttcaaaaataatttttctgacccaactttttgtctcacttttatttaggccaattacatgtatgctacactgcttaatatttttccatagatcactgtggctctgctcctttttttcctttttaacatttttctactctttagttttgatagttcctatgactgctcttcaagttcactaatcttttcttctgcagtgtcctctgttgttaagcccatccagtgaacttttcattttagatattgtatttctctgttctagaattgcagatggattctttttaaaatttttttgcttaccatttctccattgtaattgtttctttgtttctttattaaattcatattttcccttaaatatatgaacaacttacaatacctattttaaagtcatttaaatgaatgctaatcaattcttctctatcagttctgatttgtttctattgactggcttttcttctggaaatgagtcacattttctttcttctttgcctatctggtaatttttgattgtatgctagacattattggtgttacattattgactgccttggttgtattgtcttccttaataaatagttgaattttgttctggcaggcaatttacttgtgaatcagtttagtccttttgaagcttgcttttaagcttttaaagagatgatctaaagtagtctttaacctagggctagtttaggtctactcctaagcatggactttctggggcttctatgaatttatcgaggattctccacagtcttgtgccatctccagtagattggggtacagtatcttgcagttatgggagcaattatctttggtaatttttctttctctagtagatattttcctggctctgtgaagtcttatactgcacatgtgcagcacagtattcagccaaagactcaagggaatacctatgcacatatgtagatctcattgtttgcactgctcccttctttctggtgccatatcctacaaattccaggcacctcagtagctccaaatcccaatatctcttccctggcctcagcaagaccatgttttggccttcttttgtgatgtcactctccaacaagtgcctccagatagaaaatgaggtcaattccatgccttaccttatctgtttccctacagaaaattatctgtataattccggataggctaagttatactgtgaaacatacaactctcaaaatatcagtggtttaaaacaacagaggacaacttctagttcataatacctctctatcaaaagttgagggggatgtctgtgttcacagtgggatcagggattacagtcctttactgcctgctgtccagtgtttgaaagcagttatttaatatgaatattttttagtttcaaaaatgtttgcactaggacacatagctctgtaccagttattttatcttgaccaaagtgaaagaacacataaagtaatgctgtcagttcattttgcatatggaggaactgtagcattgaccatggattacctaagagctccatattaagctggaataacagtgacatttttcagctcctggtttctccaaccaaccatgtaatctctagtagaaagtaaatagattttggagctaaattgatattcatgaaaaccaaagcatgtttcacaaggaggtaacagattaggggtctaagctctgatttgctgcagtagccattagtgaagttcttccttattctggcttaaggtgatattacacttacttatacttagcaggacaaactctcttctagttggatggggccacaaaattagctctggctagggagttgtgagcagaagtggtatatgtcagttctgagtgaacacttattgctgacacgagcattccaatctctatttttttcatggtgactagcagtgttcaaaatggtgactcggtcagcctgggtctctaagtgactaatgttagcagagagcccctctctactttcaatggccgggtagtatgagcaagaggtagttctctattatgtccaaccactgcaatttttgaggtttgtatattttcataatgtaatttagcctaacctgagtgatacagataactttgataaaatttgctattttgattgtctaggttggttccccagaagcagaccctgaagtgagaattagtatacaagggacttattaaaagaagtgctccctgggaacattgctaaggaagtgcaggaagcaggatggggaagggaagaagctgagttatggaatgatctcaggcaaaaccccctcatttgtcatgctgcagcatgatctacaggggagctatggaatggaagttgtgcctcggtgatgtctcaactcaaggcaagtgagttggactatattagtccattttcacactgccgataaagacatacccaagactgggtgatttgtaaagaaaaagaggtttaatggactcacagttccgcatggctggggaggcctcacaatcatggcggaaggtgaggcttgtcttacatggaggcagacaagtaagaacgagagccaggcaaagggggtttccccctataaaaccatcagatcttgtgagacttattgactaccatgagaacaatatgggggataccacccacatgattcaattgtgtcccatcaggtccctcccataactcatgggaattatgcgagctaccattcaagatgagatttgagtggggacacaggcaaaccatatcatggactttcttatatccacatacagtctgggttggggaagggagagtggtgaatggggaatctgtagaaggagatacacgaacatctggatgaagcaccagcatggtatactactgtgatcccaggggagaaagaaaacactccataacttcattttcagttctgtacaatgggaagacacatcgtttcttgtctcttgtaagaatggcatggaagaaatgcacagcaatgttatttgagggtagaaatgctggtggtttcagtactctcagatggaaatacctttccccccttatgttattaggtcttaactgtcaatatatccctataatatggccactgaattttaccccaaaacgtttacattctctgctactttctcagcctctaaatcagcttagaatgaaaaaaagagcatcaaaatttgccttcaactcttgctacttattatttgctagctgctagcaggatactcagccttttgctgcacaaaaagacatgggtcaaaattgcttgtttctttgtcaccacttgatttacccactcaccagccccgcctgaatgactgctgcctttttatttggcttagattgcaaggctctgcgagcttgtctaatggggcagttttctttaccatgagctctgaatgagttacactgcctttgtgctcttttgaaaggtaaagcaaatggaattttgcctgccatgatttgaagtgaaggtgtgtgattcttttgctgcaattgatggtactgttagtgctgaaggcagatcaggaaactctggtctttctgtgttttggtgtgactaatgtggaaagacttctcaggtcaccacagtaaagtggtttgggaccaactgccaattaggggagtacagaatcatacccctcattttcttttcctcctatttttgtgatctcccctctctatactcgcacccttttggcttgttgccatttctagacaaagtatttcctattgcaatctcagtttttcatcttgatttttaagctgataaaatgtctattatattggcattatagctgatgtctaagcaaacttcactaagaactttgaaaaatctttactgttcactcccaccctacttactttccacatactgacattgtcctaattgtttagagttggtacttcccctagaattttctgcctccagctctgtcaactcatataccaaaataacatgtcaaatcagttgagaaaattgatgagactggctactgctacttggcattgtgtcaagcccacaaaacctggcaaaatcagctgaatttttcactttttttctaattgggtgagtaccatgtagacaataaacatactgtgtgattagagctctcaggcagaaagaagcagtctcatattttccccaaacatcattggctgagaagttagtggttttgaccttaccagatgtgtggccttgctggtcatattaatttaactaacattttagagtctcatactcctgacttatgtcttaggatgagtttaataatattttatatacctttgcagtttacaaagtgctttcgtataccccattttttctgcccaaccatgtgtcctattgattttgcagaattaaactgtgctccctggcttgagataatgagggctgggttgggctgaggagtgcagttgatattggtaatgtcaaagtctataagagatctcgagtaatcatgtaattaagcttccaaggacaatggcatcaaaactgtctagagctggatgtggtgagatatgtttgtaatttttcaagaaaggagatgctgcatgcttgagatgctttcaaggagatacagggtagacctgggctccaatcctgaatctaccacctatgaacggtgtcaccttgagtaaattctacatctgtgagcctcagttttctcatttgtaaaatgggagctaaaatgcctggaacatgcaatatagtcaagatgaaatgaaacaatgcctgtgaagcatgtgcccagtgcctggcacctggtaagtgctccataaaaggcagtgattattctgggcactgaaggattcttgctgttggatttcttcctaatgtttgcttccatcttttttagaaagctcaggatacggaaaataaatgagtgcttcaacccaactagtgaaaattcacactgtagagcatgagagatgatcgtgtccaaagatggacctgaaaacaggcagatttcctattttgttcagtgtcttacaggttcagggccaagcccggaggctgctgcctggaggctgctgcattattgatgtggacttgctccttgcacaggtgccgtgaggggtggtggaggaaaatagagacacagggatgcagagcagggatgccttttcatcgttctttcaatctgatacctggagagattccaacagaggagaggagaagaagggcctgatgctcactttccttccaggcatgagggctctatgtggccggagtccggaggtcttgtcccctgacagccctctctgtattctgtagtgtgactccacttccctacctcaagtgctctctgggctgtgcacccacccacactgggctctctttctttccatgcccctgcctctgttgaaagccctctccctacttctctttgccctgtcaatccctacacatactttagagcccagctcaactgccgccttctcaggaagcaagcttctcctgatttcccaactacctgcagtttctttacatgctctcatggtgaagtgaaaattgaacatttatttctattcttacttgattcatgcccactagactttgagacccatgaagatgggcagtgcctcactcagagcctggcacatggtaggtgttccctaagtatttgtaggctggatggataaatgggtggatggatgagtattcagaagcaggtacaatggtccgtggtttgcccaatgtgctgaagaagcaagggctttagcttcgctattgcctcgaagtagctatgttcagaagctttagatctctgggcaaaatacccacatacatagtgagaagaggcatgacagaaatgtagggcattcgtgtagccctagtgtgcacacacactcactctcatgtgcaccctacatatccctcttcccccaaagataacaaattttgggcttcttggttgttgtgcatcggtttgcccctttgaaagatctaccccttcctcttcaattcacctcagttccctagttctgacacatcaggctctgcctctgcttctctgctcatgagacctcctgccggcgacctatgtgatgggaccccacacccagcttttggaaactgccacctgcttgctccatatatctgctttctgggttctccaccctctgcttttcttctcattagtccaaagtcatgtggaattggtgtctggacatcctgaatttcaacccagtttctccatgatgttgagatgccctttattactgtttcttgtttgtccatttccacgagatgacaatgcatacagggaacctcatctcccagtgtcatggtgaagactcacctgtactcaagattcctttcctgttgctagaggttcttcataaatcgtattcagtatactgagatctttgaacgataagaccatacccagttggagaacactgtgaaatccctacttttctaacattttcagaattaagcatgcagtgaaaatggttcgcctattcaggagatattggccattaacccagacagatgctcacaaataatgtcttgcactcactgtataataatgagtgctattaaatatgaatgacctcatttgtcctcctggcatgtgtgtcccatagagagtgacacatatgtatatcgtcatttagcatctggagaaactatagcctagacaggttaagtgatttctatcaactcccaaggctaactattaggtgttgaatcttgagaaggcattgcactggccagacttgagttgtaaaagttgtaaattatagtgatgatagaataagaagccaaaatatatacactgatgtggatcaacagagttggagctaggtcaggaggggacacagcacacacagtaaaaacaggagaggagctgatcaggaactaagaatttagcgtatagaggagtcattgtgcctcagggcataaagagagaagctctaaagcatgcttctcaaagtgtaatatatatccagaactcctaggagtctaatgaaaacccagattctgatttgggaggtcagagataagtcctggaactctacatttcttcttcttcttcttcttcttcttcttcttcttcttcttcttcttcttcttcttcttcttcctcttcctcttcctcttcttcttcctcttcttcttcctcttcctcttcctcttccccttccccttccccttccccttccccttcctcttcctcttctccttcttccccttcttccccttcttccccttcttccccttcttcttcttcttctcctcctcctcctcctcctcctcctcctcctcctcctccccttcctccccttcctcttctccttctcctcctcctcctccttccccttcctcttccccttcttcttcttcttcttcttcttcttcttcttcttcttcttcttcttcttcttcttttcttcttcttttcttcttcttcttcttcttttcttcttcttcatttctttagagttagggtctcactctgttgcccaggctagagtgcagtggcacaatcatggctcactgcagccttgtactcctgggctcaagtgatcctcccacctcagcctcccaagtagctgggactataggcacatgccaccatgcttggctaagttttttttttttttttttttttttttttttttttttttttaaactattttagagacagggtcttgctgtgttttccaggctggtcttcaactcctgacctcaagcaatcctcctccctcagtctcctgagtcactgggattacaggtacgagccaccatgcccaatgtattctgcatttctaacaagtttccatgtgatgctggtgctattggcactggatcactgtgaatagcaagggtcttagccctggatgggattaaagaagaccttgtgtcaatagggctcctcttacctgaagtctcttttgaaagctccatatctactttctcagtagggtcttcctacattctagggctggaaaggtgatggtggtcagtggggaatactaggctatgcccaggtcctggaaattgaccaatgatttttctcctagattacgttagcaacaaccctactttttgaagattgggaataatttttcccctgcaatgattaattcaattggaagggaaaagaactccttgccattggtctctttgtgaaggacaaagcatgtatttgttcacagagttgaaataaataatagaaaacaagttttcctgaaagtatttacagccaagagcctcactaaaacatccactacacaaacactctgtcttcagcaagccagagccaagtcaacgttaaacttctcggcagccagtggctccatgccacttcagtttgccaagggagtgatgaaggatgcccagaatggagagcaaaaccttgcagagagacagcaaattatggcatcaacttaatggaaatctcaaatgttcacccagaggctgacagcttctgtgctcccaacagcccatagggtttgctgtgtagccactaaaaagagaaatcaaagtccagtagggagagagcttcacaggttagggccatgcaggctgagaaatagatacatacatccatagcttggggcactgtgcttcagagaatcagagacagtcttgcactggtgattttggatttttctaacagcagaactcaatagtattaggataggttcactgttcaccaagaattaatctgatgaatattttaccccccttaggtgaaaatgttcttagtagtggacccacctcattcatacaaatgcagacctatagtctgattctaaataattggtcctctgaacatatcctgtgataagcctaaagtatacacaaacttgcttggtaatagtcttgggcaacatgcagtaggaccgagagtaagggaagtctcattctctgctcttacaaacaaccacctggagactgcatctcatccaactccccagccttgaaagagacactacaatctacaaactcaggcctagaaggcacaaagaatatggttaaactgcatcagtttaaccatcttcatctttctttcttttttttttttattatactttaagttttagggtacatgagcacaacgtgcaggttagttacatatgtatacatgtaccatggtgtgctgtacccattaacttgtcatttaacattaggtatatctcctaatgctatccctcccccctccccccacccctcaacaggccctggtgtatgatgttccccttcctgtgtccatgtgttcttattgttcaatttccacctatgagtgagaacatgcggtgtttggttttttgtccttgcgatagtttgctgagaatgatggtttccagcttcatccatgcccctacaaaggacatgaactcatcattttttatggctgcatagtattccatggtgtatatgtgccacattttcttaatccagtctatcattgttggacatttggcttggttccaagtctttgctattgtgaagagtgccacaataaacatacatgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgacactttttaatgatcgccattctaacaggtgtgagatggtatctcattgtggttttgatttgcatttctttgatggccagtgatggtgagcattttttcatgtgtcttttggctgcataaatgtcttcttttgagaagtgtctgttcatatccttcgcccactttttgatggggttgtttttttcttgtaaatttgtttgagttcattgtagattctggatattagccctctgtcagatgagtagatgcaaaaattctctcccattctgtaggttgcctgttcactctgatggtagtttcttttgctgtgcagaagctctttagtttaattcgatcccatttgtcaattttggcttttgttgccattgcttttggtgttttagacatgaagtccttgcccatgcctatgtcctgaatggtattgcctaggttttcttctagggtttttatggatttaggtctaacatttaagtctttaatccatctcgaattaatttttgtataaggtgtaaggaagggatccagtttcagctttctacatatggctagccagttttcccagcactatttattaaacagggaatcatttccccatttcttgtttttgtcaggtttgtcaaagatcagatagttgtagatgcgtggtattatttctgagggctctgttctgttccattgatctatatctctgttttggtaccagtaccgtgctgttttggttactgtagccttgtagtatagtttgaagtcagatagcgtgatgcctccagctttcttcttttggcttaggattgacttggaaatgcgggctcttttttggttccatatgaactttaaagtagttttttccaattctttgaagaaagtcattggtagcttgatggggatggcattgaatctatagattaccttgggcagtatggccattttcacgatattgattcttcctacccatgagcgtggaatgttccatcttcatctttcattctcagtctccttgcaaagccagtagtagtcttgggctgtggaatcagtttcttagtaggagtagtaaatcacctcacatagggtttgagcctaccaattaataccctgagactgcctttgccaacaaagctcactaaacagattggtctaagtaggataaatactaatcagaaaacagcatctctaatatgtaaaatctgcaaagagttcatcatttggtagaagctcagaagcagagaagacctgtggatttagaggacatcacatcatgacagtgagccacaggaagcaagtgttgttggaaatgtctgacctctttgaaggtcaattgggttttgcattagacagtgggccacaaattagagatcttgagcaaattccttagtctctctggaccttgatttctcatctataaaataatcttaaaggccttcacttccagctctgatattctaatttttctgggcttggaaaaccatgctcccagagctgcctctgatctgcgtgctgttctgagaccattgcttgatgtctttaagctctcttttccctctagcaatagttacccatcaaatgtcttatgatcattggttgaaagctaccagattgagaccgatatctctgttagtctctgacacttggatttgggttcatatatgtggaaatcaatctcctgtaagggtacagcagctgaaggcaaacctttttgaaatgctgcactattaacatgcccctttaatgggtttaaagtttgacatctgactaataccgacatggcatatgcctggagaattacagccatgagcttgggtaaaaacattttgagtgcccctccaatttttgttccttatggcaaataaaccacatgatgctctctttttagtactcagccaatgcctgggggccccaaggaagagtggaagatagctgaggaaagggagatctgatttattgctctgattaatcatggagggcaggcaggcattgctctgatgttggactttctcctgggaagtgtaagaacattattctcctcattccttgcacaccaagaacatttgctgctgcttcaagcacagaaagagttgcataaacattttaatattgcatgaggcttgtataagactgactgagtatgtgaatgctaaaccctgacacataaagagacagagagagagagactggtaaagacctaagattgtcttttttttttttttttaaatcaactggtgatgctgtctgtagtaactcagaatattttgatgattctcattggagaattttgtcattgtgatatatcaaagcccatgatagatcaagcccaaacaccacaaactgcagacgtatttcctatttttgcttgatttttcacacacaaaaaagtcataaaatcacaggcacactctttctttttctgtaatagtttggattttgctgttggatttctactaccccatatggagaggctggctttaaagagatttcagaactcaggtctatgtgtccttcctacagaatagcaggccatggcagagatgctagggggtggggaggggcactgcagggaaggacagttgcaggtgggcacctgtcacctgaaagagccccaggagagcagttgtgtagggaaaacttaacttgtttggtttagcattcagagagtcacaagaccatgtcatgggttaccaggcactgtcagtcatgctaccagagcctctagaacatctttccatagtcactctgttctaacccctaccacctaaacatccaattgccctttttgttgttttgattctaacttctcagtatttctcagatgcttcatctgatgctttcttcatctcaatcccagtccaagttcagatcatctctgcctggaccactgcactggcctctttgtttcttttaccttcatctgtcgaatctttggtacacaacgatttaaaaaaaaaaacacacaaaatgatcttttcaagacaaaaacttaattctatcacaatcatgcataaaatcactcaatgattttctctaggattcctttagaagtcatcatccttaatctggagtttgaagccctccagatctgcctccaacctactctccagcttcacctgccagtattccctgccttgcatgctatggcctagccctgttgtctttctttctgttccttgaacataccaaggtctctcattcctctggctctttacatacactgtgatatatatttacttctcagcctttcctccttccttgattgtaaattcattaagacatggaccaaaccatactcatcttgcttgttgttatggcccaggacctaacagggaatctgaccacacaataggcacttaatacatatatgatgaatgaatggatggacagatgaagagatgaagcagatgtattagtctattttcatgctgctgataaagacatacctgagactgggcaatttacaaaacaaagaagtttaatggacgtaaatttccacatggctggggagacctcacaatcatggtggaaggcaaggaggagaaagtcacttcttacatggatggcagcaggcaaagaaagagaacttgtgcaggggaactcctctttataaaaccatcagatctcatgagccttactcactatcatgagaacagcacaggaaagacttgctcccatgattcaattacttcccaccaggtccttcccacaatacgtggaaattcaagatgagattttggtgggaacatagccaaaccatatcattccacttctggcctctcccaaatctcatgttctcacatttcaaaacaatcatgcattcccaaccatcccccaaaatcttaatccatttcagcattaactcaaaagtccacagttcaacatctcatctgagacaaggcaagtcccttctgcctacgagcctgtaaaatcaaaagcaagttagttacttcctagatacaatgggggtacaggcattgggtaaatacaaccattccaaatggaagaaattgaccaaaacaaaggggctacaggccctgtgcaagtttgaaatccagccaggcaatcaaatcttaaatctccaaaatgatctcccttgactccgtgtctcacatccaggtcacacctgcaagaggtgggctcccacagcctcggacagctctgcctcagtggctttgcagggtacaggccccctcccagctgccttcactagctggcattgagtgtctgtggcttttccaggctcatggtgcaagctgtcagtggatttaccattctggggcctggaggacagtggccatcttctcacagctccactaggtggtgccccagtagggattctgtgtgggggctccaaccccacatttctcttctgctctgccctagcagaggttctccatgagggaccttcccctgcagcaaacttctgcctggacatccaggcatttccatgcatcttctgaaatctaggcagaggttcccaaacttcaattcttgacttctgtgtacctgcaggctcaacactacatggaagctgctaaggtttggggcttccaccctctgaagtcatggcccaagctataccttggctcctgttagtcatgactggagtggctgagatgcagggcaccaagtccctagactgcacacagcatgggaccctgggcccagcccaccaaacaatgttttcctcctaggcctctgggcctgtgatggggggaggaggggctgctgtgaagacctctgacatgccctggagacattttccccattgtcttggggattaatatgcaactccttattacttatgcaaatttctacagctggcttgaatttcccctcagaaaatgggattttcttttctatcacattgtcaggctgcaaattttctgaacttttatgctctgcttccttatgaaactgaatggtttttaacagcaccagagtcaccttttgaatgttttgctgcttagaaatttcatccaccagataccctaaatcatctctctcaagttcaaagttccacaaatctctggaccaggggcaaaatgccaccaatctctttgctaaaacataacaagagtcacctttgctgcagttcccaacaagttcctcatctccatctgagaccctcctcagctggatttcattgtccatatcattatcagcattttggtcaaagccattcaacaagtctttagggagttccaaagtttcccacattttcctgtcttattctgagccccccaaactgttccagcctctgcctgttacccagttccaaagtcgcttccacatttttgtgtatcttttcagcagcaccccactctactggtaccaatttactttattagcccattttcatgctgctgataatgatatatctgagactgggcaatacacaaaataaagaaatttgatggacttacagttccacgtggctggggaggcctcacaatcatggcagaaggcaagcaggagcaaatcatgtcttacatgggtggcagcaggcaaaaaaagaatttgtgcaagggaactcatctttataaaactatcagatctcatgagacttattcactatcaggagaacagcatgggaaagacttgcccccatgattcagttacctcccatggggtccctcccataacacgtggaaattcaagatgagttttgggtggggacacagtcaaaccatatcagcagagaagggagtcaatgtctggaacagtatctttctattatatctccctccatgtagaatcattgaattcggaaataaaagccagaactgagagagtccttaggaagaatataaccaacagcctcacttgataggtgaggaaaccaaggctgtgagaagtccagtgattcgttgcacattacacagtcagctaatgggcaaggactataatccagctctcctaatgcctattgcagtaactcttctggttcccttgctgcatccccaaggagttcatatttgtgacttgtagaccttcaggagatggaaggaatccttttgtcaatttataagtgaggaacctcactgaggctcagagaggccaagggccttgctccaggtcaatttttacacaccactcaagtcctagagaacagggatgggcattagccactgatcatagccactgctggctgaaatgaggcagcccaggagccaaaaaccatgtgactttgactatacatggagctacagtgatgctccctgagcaaatgggcagaattcagacttggccacatgaatttcccatttcctctgtcctcctcccacctgaaaacttgttctgcctttgtctcccctctgcctaagtaccctgggactttagttctctaggctgatcctataaactgccagcaggtgctaggtaatggtctaagaacaaccaggttgggagccaaggccttttgatttcagatctcctcgttagatagggggcagggatgaggccttggattattcgccattcagtcctttgactcctccctctgctgaatcaggtggcattgggacttgggagctgattttactggattattggagaaatgtgcataaaatcctttggactctttagggaaaaggacaatagaagttccagacatccttattatctcattctgcagaagaaggcctgatttcaggtttagaagctaagcatacagggcctgagagagcttcctgaggtccctttcctttctaataggtaggaaggaatgtccagacaatgtgtgcaatagccacctcagagtggcccttcaacccctgaatccccagtctgtgctcatcttcggaaaggctacagtgggaagggcagttcagacaagattgattttccacttaatcctggctggcaggcaggagattgagtttcccttctcttcccccaggcctgaggaatgggaacagctgagggaggccaggacaattcaattggtgaaatgcattccagaggtcttcctcttaatgccaggaggatgtcaggagcagagtgatctggagcaatcgagtgccccagaacccctacagatgcccttcatcaggggaaggtggccagggctggggatggcaccagcttccttttcactctcatttgtgggggttggtcttggacctttcagggcagcaggactgaatttcagggattgcaccttctcaccaggatatgagaacctcttggccctcaaattcaggtgctcttcacttcgatctgtgcaagagagatttatcaaaattggtgcttgtccccttccccgagaaagtcttcccaagtggtagatccttgaggggaggggagatgagtgtgggttcagagagggcagaggagagtaaaaccaagctagagcctgagagagaagcagtctccccctagtgactcagagggccacctccctagaaactataacaccgagggtaggagaagatgggtggttggtggggagagcacccgccattattctcacaaccttcctcttcttcctctggcaacagtgggtgggaaaacagaaggtgggttccatgtgatgccaccttcccctagtgccactgtgacacttgatttggcagtagtctcgatcccctcctctagtggaggcttcagccagacacccgccctcactcgggcaagctccaggtagaataagcatgctatccactagctccttcttctccacacagcatcactctgctctacccccaacccctgagaacaacatgtatccccaaaacaagtgtgctgaggtcaaaggctgcaggcctctgagagtcaggaacagaaggagaaggggaaagagaacactgtaggagcagtagctccagctctctgagtcccatttggcaagtgctgggttggttctccaacatcacatcacttctgttcttctaagaggaagattagttaagggactcaggtcacaaaaccagtcagtggcaaagccagggtcagacccagcacttccaggctccagagtctatgtcttgtaagtgtactaagaagacaagaatctcatgaatcttcatcttctctcatggcatgggacgtgcttctttttcagctggatccctatcctctttcagttttgtacattgctcaggctttcagaaaacatctatttgatgttttcaagaccaatgtattggttatctactgcagcataacaaattcccccaaaacttagtggcttaaaaatacagcaacatctgtgacattatagtttgggtaggttcggcatctaggaacaccctagctagatggttctggctcagggtcttttctgaggttgcagtcaagctgttggtcaaggctgcagtcatctgagggcttcaatggagctggagaatctgcttccataatggctcattggcatgtcctcacttcctccctgtgtggacttctccataaggctgcttaactgagctcatggcgtggcagctggtttctccctgagcaagtggtccaagagaggacaaggaggaagctgcaatgccttctgtaacctaatcctgtaagtcacatactgtcactgacaccatattctattcattagaagatagtcgctaaggctggctcgctttcacagaggaaggaattatgctccatctcttgaagagaggaataccaaagaatctgtggatgtatttaaaaaccatcacgctctgttacccaaggcaccccagtcttagggatagatgttttgttttcctgtcttgtgccaaatgaatatgggaattgcctgttcctcacctgcattggggcccaaacccaagaaagacacatttcattctgttctatccctgtaggatcatggattggggaatgtggatggtggaaggcaagcagtcacttccagtaacaccttttagtgacctgctgaccatggggagtctagcacaggagctgaaacattcagaacaaagtcctttcagcaaataagaacaaaaacaaacaaaaaaacacatgcaacagctctgagtttacttgttttaaccatttcctaatgctccaacataaatttattttcattcagttggtaagatcaatttgctaagaaactttttatggcaatgaattttactctacaccatgggagaatgcagtcagcggtgaaaacacctgggtgagcaggagtccagggcatcgcccagtcatccctctcatggtaataataacactcagagaacacgcgcaagccagcagtgtttcaagcagtattagctaatctgcttcacacaagaatcctgtgaagtaagtgctataactcatcctacagatgaggagactgagatatgaagaagctgtgtaacgtattccatgtgaattgagcagcagagcaaacctaggcagtagtgactgcagaatctgggctcttaggcattcttagtgctttacacatagccctggatgaaaaaaacaggaataaaacagtgtttctcagtttgtaatgtgaacatgaatctcccggagtctgggggatcctgttaaaaatgcaaatttggattcaataggttctggttggaggctgagattctttatttataacaggctccctgatgatcctgattggagggacgggagaggcaggaactacactttcagcaacaagatgtctcctcccttcccccatatttcttttcctgggggcagtatttctccactctggctggacttgggatcacaggtatggtggtaaagtggaggatgtggatattaaagaaaaagcaaaccttctgcctatgtgccaccctcagaagttctgattcacttggtctggggtgccttccaaaggaagtaggttttaaaagcatcccaggtgattctcacatgcagctagagtgcagaaccaagaccctaggtgtcaagctgcatattactaatgatatctctgcagccccacccaatccagaacctgaccagtctcatttccctttgcagaaactgtggccagggccgcctcacgctgtgccagccacagtcaaaccctatatctgctactgcgctgctggaggcacggtggacagaaaagtttgatgctatatttcttatgcaacggaatattcttggagcactaacaggctgccttgctttgggggcgaacagcaggcgctgcagattgaggctccagagctgggccagcgtggaaaacctgcgcgctgttcccagccagcgtgttgggtatgcaaggcacgcgccgggccgggcttcctctaacgtctcattttgcataacactttttgttttcattatgcctaaatttggcctgcccagagagcgtgattaaaatgaaaaccttattctaatagagctcgggaaatgaaagaagaaatctaaaaataggccagggaaaagggaaaaactcaaacggtataatgaccaaattgcttcaaacacacacacttgcagtcatttctcttcgagagagagaaaacagcagtgacatccatgcaggtgtttgtataatccgggtcacatcaaaactcctgtcagttttataaattcacaactctgggaaaaatggaagcaaacagtaataggagataataagaggaataataagtctgactccctgcctctcgcacagtggagtttggcgagccaagagggtatctgtaatgcactttgttctctgtggagaaacactggatggcgagaggaaatacagcgttagtattctagcacaggcctgatgaggactggccataagcgcttggtttttggcttcatttcttgctttctctaaaattagataatccagtcttaagagctcagtttaaacaatttctatagaaggcatcctctagttccctggcccaagttaaggcctccagctctaagttccgagaattccttccatttccgcatcagggggctcttttctcttcattacttttgtttaatctgtgtgtgtttagctctgccctgcatctatgtggacttggacaaaacacagtggtatgtataaagggaggaagagaggaatggaggaagggagggacggagggcgggtccttgggcaaaccatttaaattccctgagcttctgtttccaagtcagtataatggtagtggagaagaatttgggcagatgatccctaagcactctttctgttttgactctccattgtgaaactttcagtttttccaacctgcgggtcccctccactgggacagagtggttggctggacagacaagtggcagaagacatggcccagccatgttgctcacaggcacagataaggccaatagaaaagatgccatcttgcagtcacgttgtttattcacctctcatcttgtcccccactccaaccatgcagtatgatttataatttgtcctagttaaaactgagatccatgaaagctgacctatccagttgtcacagagaaatcaaagaaaggactaggactaagatcagtattcaggtcaccacccacccatcccccacaccccaccgcttagtgtgacacacccacctcctcttgtatgtaaaccttgaactcccacctggttggtctcaggctggagcaataagtggcagtgttgaagctgtgtgaccttgggcaggttactactgaagctccccatgcttccatcgtgtcctctgtaaaagaggaatggacagttttctacctcctagggttgttgtgaggatgtaatgagttcatacgcacaaagcacttaaaacaggacccaaagttaggcactcaataaatgtcagctctttttattgttccctctctcttgcatattcctgtctcagcctctgtgcctttattcatgagctcccactcctctattgaaatctgattcagctttcaaggcctagcccctcatagaccatacatcacatcccgtcaggctgggaggagctgtgcagataattaaatccaaccccctaattttacagatgagaagtcagaggcacagagaggcacagccaattgctcaaggtcgcagagccaggtggtgtggagctggctagaaaccaagggggaccgaccttgtggcccagactttccttccaacactggacagcctccctctttggaactcagagctgttattgtcggcatctttcctctggtgcttgctctcttgggaaggcttttttattagcgtataattagtaaacacttttagaatcgcctttcttgatgaatccttcatcccctgcctgctgggcatgttgctttgtacaaagtaggcattcactgataataataataataataaggtctattggattaggaggccactgtttacaaagcactttcatatatgtatgtaagtatctcatcgatgcaacaacccgtgaggcagagattatttttatctcctctagagagaaggaaacaggtttagagaaaggaagagcttgctcagaaccacccagccctcacccaggtgaacctctgtctgcaaatgtccctgttattcctgcttgcctgaatgaatgaatctattacttaatgtttcatgtggatttgttttgtttccttaactagaaagcttgagctgtgtgttaaaaatactttatcttctcgaatagcctacagtaatcacagcagattcataatgtgtacttgtggaagaaattaggcagttttctaccagcgcctccaaccccaaggagacagggtctgtccagacacacaaatgccgttggccatgtggccctaattcacttgcttcccggtcttgtgtttctcattcttccctgtaaaatgtgattaaagctatttgcctcctttcaaattctttgagaacaggctggtaactaaacattcatggactccttacacaaagggactgtaaacacaaagccaggagaaagagtgtatatggaatttccagggcctcagttttgggtcagtgtctcaggggcgcatcaggtagcagaagttggaggacagtggacaggaggtacgaggaggcatctggccaacccattcctggtccttgtttccttgatctttcattacattcttacttcattaattaataatgtcactactaccttaatattattcattaaaacagttgattccaggcaaccctgcatggcctcctctgtgaatcccacacgagagacctttctacagcccaacagcaggagagttccaaacaagaacttctccttcctcagagagggactggtggaagaaggggcccggcgcagagtcccagtgcctccctcaccttctttgcaacaaccagattttaaacagaactctttatattaaacatatggtaggccaggaatagcggggtcactcagagactttaatgaatagctcctgctaccccttcccctttatttttaagtaaattaagaaggttagtagtgactgtataaaatctttccaggtactgtgctaaatcttttccaaacttcgactgctgtcctcacaacttgcaagttactgttatcctatttgacagacaagaagacaaagcctaagaaagcctaagaacttatccaatgttgcaccattattaagtgatagaagtgggatttaaactcaatttagacagtttcaccaggaatatctgaggttccagacataccttgcaaaacactctagatttctatgattttccactaatggcccgcaccatactagatgctagatgttacactgaggccgagtccgtccactcattcattcattcattcattcattcatttcagattaaattagagggtttgtaaaacctggcattctgtgattctaaatcacaaccaccacgactactgccactaacattccctgcactgacagtttactagttgctaggcactgtaagtacatttaaattgtacttacaatttctcataccaatcctgtgaatagggattagtcccatttcacataggaggaaactgaagctcagataagttaaataacatggtcaaattcatgcaactagtaaagcagacccaagattcaggcttaggcatgcctgactcttttttagagacagtctttttttttctttttttggagagggagtcttgctgtgtcgcccaggctggagtgcagtggtgcgatcttggctcactgcaagctctgcctcccgggttcacgacattctcctgtctcagcctcctgagtagctgggactacaggtgcctgccacctcgcccagctaattttttgtatttttagtagagacagggtttcactgtgttagccaggatggtctcgatctcctgacctcgtgatccgcccgcctcggcctcccaaagtgctgggattacaggtgtgagccaccgtgcccggccttggtcatgcctgactcttaactcccaagcagagatgaggtgcttgactggagaaaggacatatataccaccatgaagggaactgggaggatcaccactgggctgtctggattaaactcacagctccaccacttacagtgcagcataacacggacaagtcagttagccgctgggcctcagtgcctcttctatgaaacagaatagtatgcctgcctcctagggttgctgttaacatttgcagagtgctcaaagtattagctatttttgttattttcttcttccagggacctgagtctgggctgttgcaccccaggggaggtcagccccaagtttctttattccttgtaccactgtgggagaaatcaggccccagactttggaagagaggtttaaagagatagcctctcggatgttactgaaatatgaacttatcctttctttctctccttaagtttcttccagacatgacagccatggacttaatagaattcaattcactaaaattctattcattctggatatgaatgatagaaggatctttcccaggaagctgcttatgggactgatgatatagatgctatttgccacacaattgtgagttacggggttccacaaggagaacagactgagtttagatgagacacttggagtcggcagatgtggatgctgtagagttcagcatcgggtccgggttacaagctgatattactacagtgggccattatttgtgcaaggcagggcctctcattttataaagaaacagacacccatatccctgtaagttctaggaaatttatttttatgcctcttcttttttaatataaataatgaatttagcaggctgtcttgggggagacagtgactccttgcttctggtgtaacaagaatatgcaaccttgagccctcaacacagttatttccttagcctgctttccctcctcctcctcctccatccactccctaattcccctcaaacccccattcttagtgctaagagattctagcttgtgacatctctgctgcatctttcttgggcacttactgcccagactgaaatggatgtttggcctttacctaaatatgaggtgaggacacctggaaaagacatttttgaatcttctttggtgcctggcacagtgcggaacctctagtagatgggctcaggaaatactggctggagaaaggcatgaatgtgctgtactctgtcggagtcagccgtatttactgggatgttcttcagcctcctccatgaagcttttcttgatggtgtcttcatctagaaataatgtcttccagtctgaaatcccatgaagtttatctcttaatggagcatcatgcttcacaatctgtcatacccaggtcctggtttcctggaaggactgtacacatcttcagatcaggaccaagttggcaccatctttattccctatacagcccctagcatggagtccattagggagatgtgtatgtgtgtgtgaacttgaacagcacattctagattgtgtgtgtgttggagggatgtacagccctagtgtccagctcagtcctaacacatgataagtgatccatgagcatgactacgtgaagcccaggtgggaaatgttgtagaggaaatgcagccctggatggtgggtcctcagaagtggaggtctccggacaggtgaccttctcccctctatatggcaccatcagccagatcaggggttcttatgtttcactggagccaggcaccaccttggttataccagtacactcacatgtgcttggtaaaaggcaaatggagtttaatctgaaaccccatcatttaaaaacaggaagggaattttttatatgtatgaaataataatgtaaattcttagggtgagtggtgcatagaagacactcagcagttgttagtagccttatttccctcctctcaggggtgtgttgcagtcagctcacccagtgccccgagacctaattgtacacaactctttctgactccatggagtgagtttttgttggtagctagaaattgatgatggcgggggtatttatgctatagaaaccagcaaatactacagagcagagcttacctcctctcttaccctcttacccaaagctggttgttaaacatttaccattggctgctcccatcccccaccccggcaggcttagatgctgtgtgcttggctttgttgtgtgtagctgtgattgggcacaacacctgagatctgtgaaggagatatgggtgagtatggaccaggatgtagaactgtgtgccttttgtgtctcatacttgtccttccttcgggaacctcctccctaggtaacacttgataggcacaaggaggcatgaagaacctgaattactgccttttcaaaacagggatttaccttgtcatctttgccatgtgtgtttcaccccttcagttttcctgccccttgcaccctctatgccaccttttccaaggctttactctaattgtgccatagctttgccaccttagcattatagagcctggggggacatttgaactggaaggggcgtagacagataccaatgcattactctggacatcatttatgcaatgagatacacagtatcaagagaagagaaaggcatcaccagtaacatgaacttgaaatccagatcagagccaggaatggaggagcagaaagattacagatcctacagtgcaatctgccatcctctgtttggccaggtcagctacatgccttattgtgtttgtgctttagagtcatgcctttggcatgaaatcagtttgtgttaggagcacgggaatatttcctgtgtgaagcaatgagttagttccatctcacacctgtcagtgagtcacaaacctgaatacatgaaagctccatccatgcagagcttttagaatcagggaacatccattttttaaggactattacatttgatctaatcctcttctcttgagacatggagataagcttgacattatgatgacccaatgtaaatactgtttgtaaatatctcatgggctggttatctctgcttcttttgtaagtattcacgggagagaccctggctttccatcctaccaaacttctttctgttgtgctacctcctcaagctacttcatgtctcatttcttgtgctcttcagtttcaaagggggggagtcagaatgtgccttctctcccgcttcacgtcccctgctcccctccagcctggccttcgacctcagcactgtatgaaagctccttatctgtgtgacacttgacaccttttttcttacctcatctctttcgactctgcagtagtctgcttgggttgccataacaacataccatggactggatgacttaaccaaaatttatgatttcacagttctagaaactagaagtccaagatcaaggtgctgtcagagttggcttctggtgaggtctctcttcctggcttgcagacagcagccttttcactgtgtcctaacatggcttttcttctgagagtgtgcagagagaaagctccctggtgtccctggtagagccctatctttataacttcatttaaccttaaataccctcctaaagactctatctttaaatacagttgcattgggaattagggcttcaagctataaatttggagggtacacaattcaatccataatgtatatattcttaatataaggcctaagagacagccagaaaaggccctgtggttgccactttatcagcacaggaaagcatagctcagaaagttcaagtgacttgcacaaagttgtcaggccagtcaacgttgaaactgggaggagaatctgcattttctgactctgcccctgatctcttcacattgttctcccaggccctccaatacaagttattcaagattcaagtcatacccaactaaaaatgcaatagtcttttctcagccattatctcattgataacatttgatagtatgactatcccttttttttttttttttttgagatggagttttgctcttgtcacccaggctagagtgaaatggtacagtctctgctcactgcaatatctgcctcccgggttcaagcgattctcctgcctcagcctcccgagtagctggaattacaggcaaccaccaccacactcggctgatttttgtatttttagtagagatggcgtatcaccctgttggccaggctggtctcgagctcctgacctcaggtgattcacccgccttggcctcccaaagtgctgggattacacacatgagccaccatgtccggctgactctctgtccatttttagaaattatggtatctcaattaaattaagttgtgaaggagaaaattttacccaaaacaccaccatcttgacaccatcactgttctttgtctgtgttacctttttaacccatatatagtcattagactcagttgtcaatgggaagttggaatgagaaatccatggacttgtcaaactcttcaagtctgacttgggaagattctaaagccataggcaaatacagaccacaaaatacaaactggttacagatagacaagtcctttctcagtgaagctggaccatccagcagccacttccctgtgctcttcacaaacctgctggacaatactagttgctctttggaattccctggccttgtatatgtctctggaaagtaatcatttgaattcaggacagagcagcagaagacacatcaagatcccaccaaacctatgctgtgactgcatctgaagatgggaagtagggatcatggggatctcacacactcttcctaatgtcctgcacccccaaaccaggataaagggctgttaggaagcaaggtgccaggcagcccccctcctatccttaaaccaaactccctcacggagataaaagtagtaaggtccagtagaatgaatatgaagggagtcagaccaactgtagttcacatccaactctgccatgtagtcatttattttttcacatcctcctttgttccagtaaaatttttgaatggctttctgccttattacttgctattaggatgacattcagaaagccatcttgatttcaaactctcagtatgatggagataataacagctaccttgcaaggaaggctgttttgaggattaaatgaaacaatgtatggaaggtccaagtacaacatgtggcacatagtaggtgcccaacacataatattcattattttaaaatggaaatgtacttgtgtggtaagcttgtgtttccagaaccttgcttaagtaaatgctcttcatccatattcttctgtaaaactcatatgctctccgatgtagtttagcttctgcataaagtttacactgacctggtgtcatcaataagggactcattattccactggtttggtgaagcaatccctggaaagacattaggatttgggaatggcaggtgagtatggatggggctaaattatttacttcatcaaagtgtctctgggctttatcatgtaggcctgtcataggaagctgtacataaagatgaataatggtccctttaactcagggatctgaaaggtcactggggccgtggcagacatataaagttgtgtttgccgcatccatcaagatgcaattgtgtatggatgtgatgcatggcaggcagtggaggatggacttttgctttccactttgtatgctggtcatgctgggctgcaatgtggaaaggcagtgatcagccaccagaaggcccaaaaccctgtgctgacaccacccttcatggccactgcctcctatgggggagcattcagagcagcagggatttggagcacgggccagtgagaagagggtaatggcttgtctgtttttccatctgataggtatcctgggtctcagctcactctatctcccagggatctaggaaattgatggaagaaaaatgaggcaaagtgactaattctgtcactacgatgtgatgcacctcagggttggggatcagttggctctgggtttcaggtttcttggcctgaaaaggagggactgagactcttgggatccagagcttcagagaagtcacgtggcttctctgagtgccagatgcttttcagacgaggctgcctttcatcttctctccaccttcataggagacaccagacaaatgtgacactatgggcaagtcatttcctgcactgggaccaacatccttgttctccaaactctggtcacatttgtgccacctccattatccatgtcctctttgtgtaacttgtacttagtatcttttcccatagactgtttttaatttcaatgcatttatttttaaggaagaaaccttatatggtttagtaattgcatatagaaaatacattaaaaaaagagataaaatgaaaaccaaacaatgagattagatccttgatagatgctttggccaaatcaaagtctctaagcctgaagcttgctctctctttgttaaaaaaaggagcttggcaagtgtcagagaagcagcacctaattgaaactctctctctttgagatactcagaagggttaaaagagaattaaaaacagacatcaccttctcacaatgtgatctaatgttatttaataatccatgcctgtgttatggaaagcatttcccaaaccatctacagtgagatgccataacaacaatagtatggattctatactgtggggaaaattctacaaggaaactttaattcccttttaactccacatttttattacttcatctattatccataatgatcaccttattaaccatttatatttccattttcactggtactacttgcttactggcttgtatgaagctggcatttatttgaactcccacctaacacttgtaccttcaaacaacttccaggtgctaaaaccattgtcactttcactcagcaaatcatcagagcctggaggcaggccaaggaacaagccctgagacttcctctgcccaaagctcctggcatgtgttgggcccctgagcacagagccctccctggcagaaggacacctcctcaccctcttcctgagggctgccaccattccaatgagtaatgttttcagacagatgcaaaatcaatagcacaagactcacaccgctatggttatcttctattctttttcattcaccctcccttggcttccttagatgagagtctggggagagattcgtctcctcccttgtttcttattatgtcactgttgtagccacaggggcgagaataacagatatttctaggttgtcagggagagataggaaaggcgagctcttggtagcacctgacaacttgccataaagactcaaggcactatttgtgggctttaagaaagttaaagttttaattgtcatcttcaatctgcacagattgtaatccttgctaaggattgctcccaagtgaaatttgaaagtactttaggtggtcgggttgtctaagatctctttaattatggtgtgtgtgtatgtgcgtgcacgtgcacatgtgcgcacacatctatgtttttccttacaattgtctaacacagacctgtggtcttttcctccaagaaccctgtttgttcctcttaccaccatctaacctaagaccgtcttctgcaactcatttgttttgcttcttgtgtctttgccacccagaaatggcccccatgcgtgcctgtacataccctatgcagtggggagagttgtgatgaatcagccatttccccatctgacttcctcatggtgtcaccaactcctctaccttcccccggaaggctttaagtcctcaccaatctattttgacaaaccccagcattccggacaacatctgcaaatattgacattgctcaggtagaaaatcctgccaggtgaggacatgggcaggtagtctcaactgggcttcagcacagctcaaagttttcagccactgtgcaattttagttacctttgtgtttgcccacatcagctggcggctccttctctcccaactttaattgtttaacggtagcttctaagctatctttcattttggggggtgttcctagatttcgatctcattttctcttttctaaatgatttctttcctctgctgttatcacatggaacccttttcttctgatttaaaacactgttagtctttctcccatgctattaagaagcttcagcatcccacacctctccccactgacagcaattacagacccaatgcacacacgcacaccgtgtgatttaggctttgcattcaactctctctgacctcttaccttagtcttaagaccatcctaagggattcaggcctttccatatggtatcacagttagaagactatgaaaaaaaagataacaatgcattgatttttatttaaacatctggatatttgaaggcttctggaaattacttacctactgaagcctggggacgtatagacacacacagacacccctccatttcacctcctcactcacatgtacatggcttgtcaaatgtgctgagttccttatggtttgggttctgtaatcctcagctggtatctctgctacctagcccagcaatatgaagatagtgctcagatacaggagtgaaatagagatgaagagtcagggatggagaggtgggagaaaccagcagcctgaacacataaacagagatgattaaaaagtgctccccattattcacaatagccaagacatggaatcaacctaaatgcccatcaacgatagactggataaagaaaatgtggcacatatacaccatggaatactatgcagccataaaaaagaacaagatcatgtcctttgcagggacatggatggaactggaagccattatcctcagcaaagtaacacaggaacaggaaaccaaataccacatgctcccacctataagtggaagctgaataatgagaatacgtagacacggggaggggaaccacacacactggggcctgtctgggagcaggaggaaggagagcatcagcataaatagctaatgcatgtggggcttaatacctaggtgatgggttgatacatgcagcaaactaccatggcacacatttatgtatgccatgtaacaaatctgcatgtcctgcacatgtccacactatgtaacaaatctgcatgtcctgcacatgtatccaagaactttaaattaaattaatattttttaaaatagtgctcccaggagctcgagcctatttgtatagtgcttctatcctgtagcccttaatgtgtaaggactccttgtctgttatgttagctgccctcacagtcattctgtggggttggcgaggtgggcactatgactgttctcatttcatttaataggtgatgagttgtttcacagtgggcaggtctgtgcaaacttagcccccaaagttcaaggaagctgagaggctgaaaaagaggctgacagatccagtttctcagaaacatttaatagaggcttccaaacagaaaccagacaagatagtagatctctgcaccattactcctcaggcccgggaaagggggatatgtgattcagaagtgatgtgtaggacaatcaacgcaccataacatcaaggttgttttgacatctaggggcaggatttatagtaaatacagtgctgttatgcaggaacaatagataaactggaaatcttacaggccttccgagaactagggttactcaaaagtcaacatggcagattagcatccaagatggagtttctttagcccccaacatgggtctaagaaacagagagggtgggcatactttccaacttggaaaaagtcagaattaggactaatgggctgcgacgccagccctggtatcaccttaaacccaacgcagacaatggaaggcaatggaggtagagtgggagtcacaggcctccacggccgccaggtaagtgagctatgatggctcgataacctctctgaacctgtgttgccatatctgctgaaggcacacagtcttcctggcctgccttacttttaaatggttacagtcttaagctgcatatgaggtgagggtttgaaagtccgttgtgacccaaacaatgctgggcattagtccgtgttaggcttcagggacaaatccataccttgtatccaggcccattctagatatttaaagtctcattagttgggagtggaatgagatggcatcaagggagacagagcatgggctgccctgccttgtaccccacctgtctgtggggccagtggcaacaggcagccacttttaactttcacttggaaacatatctttacattcagtagctagttcttagaagatgagattactgttctgaaaatgttctaactgcgggcttcacagataggcaggcttttatattttgcaatgctgtaatgagcaaaaagaaaaagagatttagttttcctggtctgcccctgagtattgcctaattgtcttgaaaaacaattgacttggtctttctcattcagcttctaatactgaacatatgtatattatgtctcccatcttacttatctatttaccactgttgcttgggggaggttaatttattctcagcctaagttgtttgttccctaaaaatgcctcctgtaagggacattgaggcagagcccatatacacatgtaaggaaatggagaacagcgtcttttatgaggcatgacgcaccaaagggtttgggcttccttcccccacctccaacctctaagcttggcatcccattatttatctgcattacttcttaaatctacatttcactatgtagacaagccgagacaatgtttattctacatgaatgaatcaaccctggtgcagtcaatttatttctccttagtaggataaaaagacaattgccatgtgatggattggatgaaacatagagcaatcggaaataatggtgaagaaggtaaagaccagcaccctgacagcccaatgttatttttctctctaaacagaggcggatatggctaaacccctctattcagtttccacaccttgactgtgaagaataccccaagcgtgagagtggacttgcgtaaacaaccaattattgttttacaaagttaatcaccagttgctggccttttagttattattaaggaatcagtggaattcaagcaaataagagtctgactctattcagctttacaataatactttgtgggagcttcatctcttctggcccattctctgcccacatctgctgcctaatgggctaggttgttcagaagctcatgttgatggagttgcagcaatgacagatttctttggtctgaattacgtggactattgcccaaattgccactttttgttttgctggcatagacacagctcattgagaatgagtaactccctgaggttgctttaaaaaaagatttggcatttaataaaagcaattccttacttgcataacagttcaagccattttagataattaagaaagaattcctttgaatacattgtaactactttttaaaagttctgttatttttttaaaatcccatttaggttatttgcatttttccaagaaacagagaactgtacctaagccaaaatgcatggtttgggggtcagtgttgaggggatggctgtcactgtctaaaatatgtcttgggccttctgtttggtttttcaaccctttcctccttctcctcattattataaaccacaactgataaccaaaaaaggaaaaaaaaaaaaaagagttccagtctcttttgtttcttttcccctttccagtgtaggtacaagggtatagaacagtgatctaaaaatcatattggcagaaggggatgggtagagaaaaaatcctgaataatctaccaacttgataatcataccctgaatatagatttgggatttggctctggagggttttctcccctcccctctcttcccctcccctcccctcccctcccctctcctcccctcccctcccctcctctcccctcctctcccctcccctcccctcctctcctctcccctctcttcccctcccctcctctcccttcatctcccctcccctcccctcccctgccctcccctcccctcccctgccctcccctcccctcccctcccctcccctgccctcccctcccctcccctcccctcccctcccctgccctcccctcccctcccctgccctcccctcctctcccctcccatccccttccctcccctcctcttctctgctctactctcctctttctcttgataagcaagaccatggaagttgcccagtgcaatcaacctctaagctttcttcttttctcattcagtctccatacttcactgagcttaagtaggtaactattttgggagacatgcatgggtttcttatgtgactgagccaaatatatttaatcttgattagttttgggagattttgttttgacatttaaaccaagtcaacatttaaacagaattattttctttgattgtacagttttccttacagaacaagaggtagattttgatttggagtttatcattattatcatcattattatttatgtcccccagacctaggggttaagaagttgtttactctatcatttcccaaactgatttgccctgcagtggtactgcagctctgtagtagaaagaatactgacataagagtcaagtgaccttcaggatcctaaagctgattcttaataaataactgtggttttaggctgtgatttctcagcctccatttcctcaatattgaaatgatgtgttactggataatttctaggagcccttttaacttttatggtttgcactagcaaatggagagctgtatttctgtcctcctggaaaaagaaagaagtcaggcagggaggcaggaaggaaaacagaaaatgaaaaaaagttaagtgaaaaacagaaggcaaaaccaaggaatagaggccaatttctactaaagtggttgtgtggcatccctgatccttgaaggctgaaagtcgtgcagcaatagcatacagaatgcacgatgcaggcaaaacctatatgtctaggagccgaacttagaatcgttaaaagcaaatgagaaaactgaggtgttgctcagtataggtaggagctagaatgctcatctgtttttttctcgttgttgtttgtttgtttttttaataaaactgtctctgggactgagtgatagatgactagtcattgagcttaaaaattctatgtgtttttcaaattaggtgcaatgaagaggaactggaaattgggaaagcaaatgggttattgttttccatgtttcttgttttcttcgcctactcttggtggaagacatttctcacagtatctgctagttattatgcatagcttttctttttcctccatcagctaggtaggggagcatattcctgggcctcatggtcttccataggttgaaggttgtgtctctcttgccatctgtaggttcttgggaggttgggggagctgcttcaggacctgttcctccctgaggttgctctgcccctcacagtgagtaggacccacctaccccgatttgggtgagagaggggaggccagcgcccacgggagcccacaggagggagagaggagcatgggcacgcttagcggcgtggctctgatctgtcaccacacatcacagatgacaaatgactatactgtaaattactcagctccccaaattgccttatttaggactcagaagccccatgcgttgggaatattgtggttcttcctctctgcctgttttaccttggtggttggatgggtgtggggtagatttgagcccagagggctctccttgcatctcaaagagaagagcttgttgttaagtctgaggtgtaggaaacctgagtgcctccagggctctggtccttctcagcaacctccctgttgccacacttcagtggaaattcctgggtaccctaatcctaatgattttagggctggggttggtagctgcagggggttgtaaggagttctctgtccctgttgaccagccacttctgccaagattcctggtccataaggaattatcctctgcatagtcccaacaccttcttccaactgttttatgtgatcatcttacattgcctgtgaacgcaataaaaccaagtaatggttcacattccttgcctgagcttcaggaaacggctgggaatgatgaagaaacatgcaaggatttgtttctgtgctcagatgctaaggactaagtctggttccttgcctttgcccagcatgctggtggctggactttcctgaagtcctctgagaagttaatcctgctatctctcagccatgagggctgtgccccacctgtcactcttcagcctcctctcaggcattgcctcctctgaggggtcctccctggctttcacattcctctccacccctcactttcatctccaatgagtgtcctcattccggactgtcatcattcttagagcacggcacgcaccacactgaattatggttgttactttgcatgttcacctcccctacttggagtccggagctttgtcctattctgcaccctaatgcggcacagtgccaggtacagagaaagttctgaacacaggtgtgctgaatgaatagatgaatgcaaggatgctggctcggccacagttgttgtcattgtactttttggtctagttttgcatttcttgatcagccaaatgtggtttattgatgacaatacaatattacagtatgcctttttctcattttgaggtctttatgatgatttttaatgtatttttctgttatttttgtttgtcaactcttctctctcttaaaatattgttttacatttttatttattttactttatttctgagtcagggcttgctctgtgacccaggatggagtgcagtggtgcaatcatagctcactgagccttgaactcctggctcaagtgatgctttcactttaatctcttgagtagctaggactataggtgtgtgccactgtgcctgttttttgtttgtttgtttgtttgtttgtttgttttgttttgagacaggatcccactgtgtttcccaggctggtctcaaactctgggcctcaagctattctcctgccttggcctcctaaagcactgagattataggtgtgagccactgcacccagctgctattactttattagtgtttttaaagtgatacatggtcattctttccaacccaactcttctgtgaccccattctgaaccacttcagcatccaagttggtgcccttgctggatttcaatggctaattcagaatttagaagtttctgaaaatgtttcttttcaacactcaaaagagaagtggaaacaaatgatagagaagcaactatggaaagtttgttggtttttatagtaacctggctggtgaaaaagcccatatgaacaatatctagctggtgcagctgtggcttccaatttcagacaatttcaaatcccctcatctcattgatttctcacaatagctgtgtgaggtaggtggagcaaattttctaaaatttctattttatagacgagagaatggaaactcagaaaagctcaatggcatatccaagttctcactggtggtaagcacaggaggaatagagccaaggcccctgactaaatgcagtgtcctcgccatcacaccgatgacctctccattctttccctctttctccctctcttttttttcccccaggaaaattctccagaacggtcagagtccttctctctaggattgaggtttctgggtattattctccctggggtggggataaagccgtccttacctaagtgcggcttaaaggaagaaaaaagttctttgggttattatcatcctacctttggatgtccatggaagcatagagggttctagatatggtggcaaatatagaatgtggccaaagactgtcatacctctcgagagcttcaccattctttaattgccttttaaggtacatttgctgaaaagacctggatgcgaggagcgggggtttttgtactttgtgatgaaaagaccaaattctacatattttctgtccagcacaaaatctcttcaaatcatgtatggtttctaaattttaaacaacaactcacattccagcaatatttgaaatcaccagtttccaaatgcaatagaattctaattccttagatttccctttgatgggatttctgtggctaattttgtccctgtgagtgaacctagggctgagtgtacttggctttcccaaaatggaaaggagctggtgatgataccaatttaataataaagcatccaaaagactccctctctcacacacacaaagagaggctttggccacataagtcccaacatggtgatggttatttccttttggatttagccttctgtgcttgtttctttattagctgatgtaatgaaggacactggcaggtgtgaggaatctggctgctaggctttgccctctgggatcgtagttgatggcaacaccaaatagtgctcacccttaagatacctggtcacaagcctgcaggcagctttaagacttccttactaaccaggaagatatggagcttaccaccccgtggccttccgcaggtggctctacttactccttttcatcttttctggtaccctttggatggccacagctaaagctttcttgacccaaattcttgggtcaatgagtaaatgaataaacaggtatagtgctttggtgaaagtaaaaaaaaaaatcctatttatctgctttttgaaaaaaaaatcaacaaatatttgtttagcacctactttgtgcatggatatggagatgagtaggaaagagtccctgatttaaggagatttaaaaatctaacactactccagtaactagtcagaatatcagttccttcaatcagcaaatatttagtgagtccttctacactaagcaatgtccctggcacttgggctatactggtgaatgagacagacatggtccctgccttcagggatcctagagttccaaaagggagagagacacatgaacaagcaatgatagtggggatattactccttgctgtcctttgatgggagaaggagagtgtctgataaactggatcttaagagagattcacaggcaagaaatcaaatataactggggtgcaggggcaaagattagaggatgcttcaaggagaagcatttgaaaaaaatctttgaaagacttatgaataggagcaggaggtgagcatttttggtggaggaaatagcatgagcaaatggcaaggaagtgggagagcagagtgagctcaagaaacagagttatctggactggttagaatatacaggatgggacagttaaaggaagttatgagcagagagctgctaaacttcatttgtttttaatttttttaaaatgatggcaatctaaagaaaggttgctaggatagtattgtttgtttctatacatctttctgttagattttataatctaattatttacattttgccatattgtttctccatatatatatgtgtgtgtatgtgtgtgtgtgtgtgtgtgtgtgtgtgggtgtgcgtgcatatatgtgtatgtatgtatgtatatatgtatgtaatttttgttattgttgtcattgagccatttgatagtaagttgtgagcatcatgaccttgtgtctcctaaaattacactaatagaattttatttgtgcttattcttctacatttaaaaaaactcatgaaaggtagctcacctcctctccccattgtcataccccgtgccccaccccacaccggagcttcttttaaggtagttgcagctccatttgcatctttctgagctttgaaatgaacagctgctgaatagctaggttgcttagagaaaagaaacgagtttaaacaactccaaagttattcgtagtctctgctgggttgaagcagacagggccatctgtgctttctgttcatatctcaggacctgaaagaaaatattctatgaggcttaggagaaaatgacataaaatgaatccattctgttgtcagtgatcataatgaaactagagaacaggtacaaaatcaattcattcttattacaattttcagattgccatcttcccatttgttcagatgcaggtctgatggctcaaattggtctttgtaatatttaaggagcttttttggtcttttaatattggcttatcagttccagtaattttacctcccagagtgaaattggctgctaacgtttggaggaaatccgtgctgtatttttcgtaagttttgctgatcgtcactcaccaggctacagtaaatgtgcttctggcttattaagaagacagccacagagactggatgctttattacagatctaccgatggttccaggagctcttccctagcagagagaccctttgtgaagtatttatctatttatctatttttctgccataatacctagatcttctgtttagacgtcttctcatttgaccataaggataaaagagaaaactcaggcctacaaatgattcttttatttctccttcaaggctgtgtgtgtggacctcatagagagagattaggaaggaaaagaagggcagaaggaaaagcagttcgaaggccgttgtcaacctcatcctatctttctcctgttgcaaagtaataattggaatatgcagttatgtcctttttataaaaatgtcatgctaattataaaaataatgcatagtaattatttttcaaataattgaaaaagaagaaattaattgttcataatactacccaccaaagataactactgttaacaatttagtatttttaaatcagtctttgtgagtttaaagactagagttgattcatataaaatttttaagatgatattttcatttaatattacataaagtcttagtcatctttgttggaagttacataataacttatcttttggacatgccatatttactttatcactttttatttcaagtagctactttgcttcctagttttgttctgttttgtttatcctataaagattgcagcagtgaatattcttatgcaaaaaagcttttatgtgtataacaggtaattttcttgggatggatttcgatgagttaaattactgggtcaaaaaataggtatattgtaaaggcgatctatatttgcctttagagagttttttaaaatgctcttccagaacaatttatactcccactagaagtgtataagaatgcttatctcacgcaacacttgccagaactgcatattatttaaaaatattttttaattagatgggcaaagaaaaactgccaccttaaattacaattctttgcttaccagcgaggctgaacaacttttcatatttgttagctctttgcgtgtgtgtgtgtgtgtgtgtgtctgaattttctgttgatgttcatagccttttcacctgcctgtcttagtgtttttctaaattatttggatgatatcaggactaaccctccatctactacgtttgttgtaaatttttcccaatttgaaagtcttttgcaatatttgtatgcagttgtaacacagacatacttccatttttcgtgctttgctttatttcacttcacagatatcacaactttcacaaattgaagttttgtggtgactctgcttggaaagagtctgtcagcaccatgtttccaacagcatgtgtttccttcatgtctctgtgtcacattttggtaattctcgcaatatctcaaacatcgttaatatatctgttatggtgatatgtgattggtgatcattgatgttactcttctaattgcattgggatgccacaaaccatgcccctataaggtggcgaagttattcaataattgtgtgctctgattgctctaccaacctgccattttcctaactctctccatctccttgggcttccctgttccctgagatacaaaaatattgaaattaggccagttaataaccctacagtcgcctctaagtgttcacgtgaagggaagagtagtatgtctctcactttcagtaaaaaactagacatgattaagtttggtgagtaggcatgtcaaaagctgagacagatcaaaagctaggcctcttgtgccagttaatcaagtgtgatggaaaggaaaattattgaaaattaaaagtgctaccccagtgaacacacaaatgattttttttaaagcaaaacagccttattgctggtatagagaaagtttgagtgttttggatagaagatcaaatcagccacaatatttccttaagtcaaagcttaatctagtgcaaagttcaactctcttcaattctatgaaggccaaaagaggtggagaatctgcaggagaaaaattggaagctagcagaggttggttcacgaggttgaaggaaaaaagccatctttataacatgaaagtgcgaggtgaagcagcaagtgctgatgaagaaactgtagaaagttatccagaagatctacctaagataattgatgaaggtggctacactaaaccatcaaactaggcaaaacaaccttatattagaagaagatgacacttaggactttcatagctacaaaagagaagtcaatgactggcttcaaaaacttcaagggacaggctgactctcttgttaggggtgaatacaggtggtgattaagttcaagtcagtcttatttaccattctgacaatcccagggcttttaaaattatgctaaatctactctgcctgaattctataaatgtaacaacaagggctgaatgacaacacaagtgtttacaacatggtaaaccatgtaaactgaatattcaataaatggaatattttaagctcatttttaatacctactgctcagaaaaaatgattccttttagaatgttactgcccattgaccatgctcctcatcactggagagctctgatggagatgtacaagaaaattaatttttttatgcctactaacacagcatcctttctgcaatccatggatagtggactaattttgactttcaagccttattatttaagaaacatgtcttgtaaggctgtagctgccatagatagtgattcgtctgatggatctgggcaaagtaagttgaaaaccttctggaaaggattcactactctagatgccatttagaacatttttaatgcatgggaggaggtcaaaataacaacatgaacaggggtttggaagaagttgattccagtcctcatggattactttgaggggttcaagacttcagtagagtcttcgttggaggcagcaattggagatgtgatggaaatagcaagagaactagaattagaagtggagcccaaagatgtgactgaattgctgcaacctcatgatcaaacttgaacggatgagatgttgctacttgtggatgagcaaagaaagtggtgttttgagatggaatctactcctggtaaagatgctgtgaacattgttgaaatggcagcaaagggtttaaaatattacataaacttagttgataaagcagtggcagggtttgagacgattgacttcaattttgaaagatttactgtgggcaaaatgctatcaaacagcatcatatgctacagagaaatctttcatgaaaggaagagtcaatggatgcaacaaacttcattattgtcttattttaagcaattgccacagacaccccaaccatcaatattgaggcaagaccctccatcagcaaaaagattatgactcaccaaagacccagatgattgtcagccattttagcaataaagtatttttaaattaagatgtgtatatttttttagagattatgctattgcatacttaatagtctaagtgtagtgtaagcataacttttatatgcaccaaaaccaaaaaatgttgtgtgacttgctttattgcaatacttgctttattgcaatacttgctttattgcagtggtctggaaataaaccctcaatatcattgaggcatttcaaatggtcacattttgctcattttcttttaatcctttttactgattttaatcttagaaaatcctgtcttatctaaagatgtgtgaaataccattttgtgtttccattgagttttgttatggattatttttcttacacttactttatctgccttttattgtggtagatgatttgaattgagggttcaaatgagtttttccccaaaacttaactagtggcccccagcagtaattattatctagtgctaccctccccctgaaactgagatgtcccatttattacatattaaattcttatacagacctgagtctgtttctggagtctccactggaatgttccattattccatctatctaccttctgcaactgttccactgttccatctgtttttgtgttagcaccacacattttaagaatgaaagctttataaaatacctaatgtatagttagagaattccccatccctccatttgttttccctaacaaaaaaggttaaaactatttttagctatttgttgcaacagaggagtttcagaatcatttttcaagttccaaagaaattatattcatgttttggttagaattgtttaaacctatacatggacacttcaaggttacaactcttatttcataagctcatgttatgatcagaattgctgattcctaaacatctatggaaaacacaaaatactcattttcagataacttagtgcatctgaatcacccgattgtttagagaaaatcctgaaatgcaatgtttcaaattccctcaaattataattattaattgatgatgaatgacaaagactgtcttttggtctatattgcacaaaccatataaactagttgaaagtaagtcaataaataaatggatggatgaatgaatgagattacaaaagcgtcatgaaaaacaagagatctggtctaccagaggccttcagtatcatctgggcagtggtgactattgtttggaaatatatatatatatatttttaattatactttaagttctgggatacatgtgcagaatgtgcaggtttgttacataggtatacacatgccatggtggtttgctgcacccatcaactcgtcatctacattaggtatttatcctaatgctatctctcccctacccaccacccctcgacaggccctggtgtgtgatgttcccctccctgtgtccatgtgttctcattgatcaattcccacttatgagtgagaacatgcagtgtttggttttctgttcttgtgtagtttgctgagaatgatggtttccagcttcatccatgtccctgcaaaggacatgaactcatccttttttatggctgcatagtattccatggtgtatatgtgccacattttctttatccagtctatcattgatgggcatttgggttggttccaagtctttgctattgtgaaaagtgctgcaataaacatatgtgtgcatgtgtggaaatattgtctgacaacatcaattacatatggtacagagataggaaactaaatgtttattgagttacactgggcattttgttaggtgtttttcacatgttatctaatagaagaaaaataagataaaggaaaggaagagacttgccaagaggtcacagagactgtaagaggtggacccagatacagattcctatctcttgggcttcagagcctttgctgtcactccagtttctgcagcctggagtgacaggtctaatgtataggatcttaaaggattattttttggccgggtgaggtgactcacacctctaattccagcactctgggaggaccaggcaggtggatcacctgaggtcaggagtttgagaccatcctggccaacatggtgaaacctcatctctgctaaaaacacaaaaattagccgggtgtagtggtgggcacctgtaatcccagctacttgggaggctgaggcaggagaattgcttgaacctgggaggcagaggttgcagtgagccgagatcgtgccattgcattccagcctgggtgacagagcaagactccatctcaaagaaagattttgtgtgtgtgtgttccaatgtcaatatgtcagaaatagcaatgggtagtaacattttagaaataaagtcccactgatgattatttacccttggaaaagaaccacaagattcatcttttttctctgttatatggaagtaggtccacaagaatgtgtgtcatgaaggaatcttctggtgtatactgagaacaagaggattttgcatagattaacattttttcaagcccagtctatgtcacttgtgattgcatagacatggctcttggaggcttaacctggcatctggtcttaacatgagcagccctgctttaatctactttccactccgccaccctccatcctgacaagatagtctaattacggcagatgcagggttgtgaactgtggtttactcttcttaaaaaaaaatgacattaacattgctgtaatcatgctttagctgcatacattagagatttcttccctagagccccaaacactttgcaaatgtgatctcattaacccacatgcctaccctctgtggtaggtcggccatcttgacggcattcgggaattgaattatgcaaagagaaagtggtgtcttcagagctgcctgccagctggggatgggatcaggatgaacataaaatcttagaactttacagggccctggatattacctggtctgacatcctcaacaaataaacaggaaactgaggcctggaggggccatgctactaaactccaaggttctccacggccaaatgttaatcacctgggaagcttaaaaataatattatccaggttccactccagatcaatgtaatcgcagtctctgggacctccccacatcaatgattttaaacgctccttaggtgattctaatgaataatcatggttgagatttagctggacaacagcagacccaggagaagccccattcattcaccccagtctaggggtctgcccatggcttcactttgtcattctccaccatacagtttggtttatgacagaagttcttgaggttttaatccaggctggcatctttcatacaggaaataatcggggtaattccttggcttttcacttcatttcaccagcacaggcacattgtaaagctgtggcaacatggtgcagaagtaactgtgtgactctgccaagccagtcaatcaactggtcagttcactggacagaatcagtcaaattggttggttggctgattcagccattccggatagaatagcctgcctggttggctaagtgtggtcattactcttctagaccttgccttttacaaggaggtgtgatgatatttattttccatcataagctcagtgctagggagcactggagattctcagcatttgctctgtaaaaaaataaatgaaatgatatcctctagcattacaagcattagagattcaagagttcatcacagtgcccataggaggtgctcaataaatggtagtaattatggtgttcatattgccttgggatattgcaatgacctagactcagacccaggcagccacgcataggcatgtgcatacagacacacacacacacacacacacacacacacacacacacacagtgtaccaggatggagcatgtttttagactcggccgtttgcaaaacttagctaaagttggtggtggaaggaagaaacaaccagtctactaactcttttaccttcagaaagaagtgtcaatatagaaagtgacattggttagagaactggaaacaaaaaccataaagctctgtctgaataagaaaacaaggttacttcttaggctgtatttgaggttcagctataatgggtcccttggctcttgttccttagccctccaggttgtaaagctgaagtcctttgaccctggaatctgggattacctgtcctacagctgcagaagctcttcctgtccctttctgttctattatgacagtcagttagtcttactgaggttctttgagtctctttgctatgttcccagaaattcagtctgcatcggttgcctgtgaacctttcctaatcccttgttcaagagctgggtccttgtctagttccctccctttcgctttctcatgaatacccaagtccctatataacttctaatttctcccagacccgggagtccatcgtgcaagcaacagaaatggaaagggaaagaaagcaactgttgctcctggtctccacagcaggctgttgggatctgtctagacctctctggttttggcagctagacactcgttccttctctgacaaggaatgtcatgttaatctgtccactggaatatccctcactgcctgcctcccatgacattgtagcccttcctgtcatgacaggtgctgtggctatgtggccaggcctcgacccacctcacgaagcactcagcgagttatcactatgctccttaatctaaccagctgtactacagccagatggctggataagctaagacaagttcgtttgttgtccttatagacaggtcataggctaaagagcagacagaggctgtgaggtacatctcttagcaattgtgatcactgcttgtttcaagaaacttttttttgcctttatacaaatccctggtgtctgctgcaaatgatgatgtgttttcatttccatgactatgtctatgtgccacacctaaccaatatttccatatactaacactttgaattaaggtgtaggttctaatctcacttgaatggaattcatgttcacagaagaataccaaagattattggtgattttgattccattcttctttggttgggacatttggttgggatgtaggtcatttggtcccacccacattttcagcatcatttcttcttcttccttggaggaccacttaaatattctcccttacttaacccaccctactgtcttacagcctcttatctgcatacttactgcttcctctctacagactgtctttttctcattctcttcctggctaactctgactcattttctaaaatctgacccacgaatgtatcagctcccttgtaaagccttcctgggctactctctttccctatgcatacgtcccatggaccgcttgtcatattgctgtgagctccaaggaaaagcctgtgcattgtttatcttcacatacatgatgtgtgtagtatgagtccagtaagtgctttggtgccagtgtatacatttaactgcaaattaataaacactggccttggattgccctttgtgacttttggctcagtcatagaaaaacattaagtagcttaaggaataaagccctaattaattcatctttgtatcccctacccagcacccagcactgtgtctcggacatagtaagtacatgtattctagatgaacaatcactagatagattattgcagtgctaatgtgccttgcctaaaaatggtatttgcttgggttagatcgaacctgatgtgaaacatgtatgaaattggacttcaagaggcttctttctgttgagggggcttccattccctttcaaaaaactcccagggaaggccgggcatggtggctcatgcctgtaatcccagcactttgggaggccaaggcgggcagatcacgaggtcaggagatcgagaccatcctggctaacatggtgaaaccctgtctttactaaaaatacaaaaaattagccaggcgtggtggtggttgcctatagtcccagctactcgggaggctgaggcaggagaatcgcttgaacctaggaggtaggtagaggttgcaatgagtcaagattgtgctgttgcactccagcctgggctacagagcaacactccatctcaaaacaaacaaacaaacaaaacaaacaaacaaaaaaaactcccagggaaatcctcagaacatttgtctatgtaaactcaataagcagagtgaatacaagggaacttttcattagcatttattttccacctggactttgggctcccacaactgagactctgacctcctacagtcggggactacattattcaccttttccttgcctcacccagcacagtacacaattggtgctttataaatgtttactgagggagtggccacgtggtgatctctacacaactcctggaagccctccagcaccgtcgctcttaacacacatctaggtataacattgattgctgcggatgccatttcctttctaggagaagttatttgttcaagtgcaacttgctggcctttgcattgtcctctgaaaagaatccctgatggctgtgcagaggctttagttaaatggaataagatggtttccattttcatatagttagagagtgccactcatgttggctgatgagtgctggttagggctatgggaggatctcctatccttctcgggttctatagacatttcagataatataagggaaagaaacgaaaagactggatgggaaaaggaagaaaaaaactaacctaggcaaagaaaatgaatacaagaaaactccaagggacgtgaaaatcggtagcattcgtcattaaaaggggaacgtcaatcatccttagtctcgttttttcttcattgtgtgcctgagtgaaggcgaaaatggaaatgacaatggcgaaaactttttaaagccactttatccaggaacagtgaataagaaagatatttagttccaaccttgcagagagggtaatgtgtgtgtgtgtgtgtgtgtgtgtgtgtgtgtgtgtgtgtgtgtgtatactcaaaaacatttccccctatgtaaatgatattccccctgaatctctcctgtgcttcctgataccaagggaatgaaagataggggagcagtcagaagtcacagagagtttgctgacgggaggccgggggtggggggtggtgagggtcagtagtgtggtagtggtctgtggctttggggcttatactaaattaattttcccactgcaggattcattttcaaccccatctactttctttcttggtctcagccttgcagcctgcacacatttgtatgctttgcttcttgttttacgcatttttgcaagtcacatggacttatgcccatgtaactcacctctgttaatgcaaggttgtgtgaaaggttgtggacaaatggaacttttgtaaatcgaatcatctttcagatgtatttgggagctttctatttaacagaaggtaggcttgagtcttgggcaaaatgaaaaagacttcagcaatctcactcacattccagtttgtttcttctgaaaggtaattttgtgtttttatcgccaattttcttaaagctgagtctggttttcctgaagcaacaactgtgtgcctgctgtttgcaggatatcggtatgttctgctgaaatggctcccacctccccactcccctcatatataccaggaagtgcctgggacagaactgtcctctgcttgtgtctaactccttgtacccatgagcttacgtgcaccaggatatcagcagtgcttagaggcaggtaggggagagagggcagagtcctgtgagaaatctgtggccagagtgtaggcccagctctccggatgtctaagccagtacttgtccctctttttgctatgctgtcccccacagcaggatccatcctgaaaagggatacttcttgtcagtggttcagggcagctcgacttgatcctcccttctgtgtcagaggcacattcaaaactgctggtggaaggagatactgcctctgtggatttctcgtaggtcttctagttgagccatgctttataaactaaagcagaagagagcactgcatctcttgctaaacaacagggagaatggtttaggaggcactataacgtaataacatagtgcaaaggctaggttggattcctgggttcaatcatagcttcaaataattagcagtctgaacttggatcagttctttgttgttgttgttgttgttgtttttgttgttgttgttgttgagacggaggtcttgctctgtcacccagcctggaatgcaatggtatgatctcggttcactgcaacctctgcctcctgggttcaagcgattcttctgctcagtctcccaagtagctgggattacaggtgcctgccaccacacctggctaatttttgtacttttagtagagacagggttttgccacattggccaggctggtcttgaactcctgacctcaagtgatctgcccgcctcagccttccaaagtgctgggattacaggcgtgagccactgtgcccagcctggaccagttctttaactccactcaacctcaatttcttcacctatgagacagatgtgttcctaccagcctcagaaaactgtgaatattatagaaaatgtatatgcagcatgataggtgctagataaagagaaactctcgtcattcatgtttattagcactaaagttcctttcatcccatctttgtcttgttgtctactttgtctacactttcattttctgttatacttctcttgtggtttcctaaagacattttcttagttctatctccttgctccctcatttctttctttcttcttctgtctccctctcttttctctctctctctgtctctgtctcgctctctcgttgtctcgctctctcatatctaatatcatggcattcctgttctttcttctatataagaattacaacatttcaaagctgaagtagcccttggagtttctcagttctagctcctatgtgtgagatgagacaactgatgcccagggaaattaacatcttacacacgactgccacttggtggaatcctggaggactgggatgggtgctcaggccacctgctccgtaacaacactttgtccctgggggtgaccgtgggagggagggtcctctatccccagggaacccagtgaggacagggatgttacagttctttgtctccctaaagggtagtgtttttcctgtgtcctttcgaactcctcgggagcactttatatttcaaagctttttgataaaacagctaaaccaactcctctcctgggacagcaaaactcagtagagatttctcacaaaattctcttattgttggactggactgaggatatttttaatttttttcttgcaatcaaaaaaatttacagtcactcagcatggatagtacatcatgaatgggcagttgtgggtctttgatctaatttttatgtgtctgatttctcaataataaatgggcttttgttaggagacaggttgacacttactgagtttgctctttatgggtctgtagtgagttgggagccacctgtggatgtgttctcttttcttggtcctacagcaaaactgtgacttgacacataattgaacattgttgcctaggccctttcagtattccaggcatttgaaaagagagaaaactgtgttccatccaagagaatagcatcgaagctaaatgtcaggtgacaatttagcatagttgtgactgatatgatccatcacaaaggggggaagaactattgattatgatgtagatgagagaaaaacacatcccagagacaaaagtaggaaaaagcgaagagcccgtaatgtaaccagttgtctttaagtcactgcccttgaggaatgacaaacgccttgcactggctcagatttctttgaacagcctagaaacagaacacaacactgctaccatcgcaggcaggagttatgttaaagaaagatgttttgagtaatgttcatgaacagcaaaatggctcacacaacaggacatccttctagaatatggtcagagggcattctgcaaaagggcctgagaatgaggactggggaagaggaactggcataaacatgtcaagaaggctcatttgtctatactcttgaaaggtgagatgagaggcagaggcacacagaaggctggctctggggaatgataatggcatttgaagcttttcacttctgtgtaggtcactggctcacttcaaagcctaactgctcgaaatggttactgcttgatggctgatgggaaattaggtcctggctttcaatctgcctcctaaaggtattccctgggaattggtctcccttcctggaagactgacaaaggctgggaaaggcaacaggtacataactgttctgacgccagaggggatcttgctggagtggggcggggttaacgctggccaggcacaggagagggaaggccgcgaggggctagtgatggtggtgaatgggtgcggggcaccaaagaagaaaatgctttattcctgcagcccctggaagtgtgagggctgcaggaatcctggggccaccagtgggctgaccagcttggggaccatagacagcaagttggatggagtcccatgaagaaactcatgcctggctccagagggcacagtcctccttataaacccacaggtctcttcaccctacctctctctgatccacctctggctccctgactccagagaatccttgtctaatctcagggcaggcaaggctgattgatgggctgtgttccaaatctcttacttaagactcttgcaaagcaatttagctcttagaattaaacaacatttttgtgtttctattattgtcccccctcccctgaggcaatgacatgaggaagagatagggtaagcagataaggggaaatctatggaataaaaagcacctcagttaatatctccaactgtcaatcctgctatacttccctacttgtttttcttttgacactaacttgactcctgggcttttgaagcttgcactcaggctgtcggggcgaccactgtgggcccagttctttctgtctagaggaaactccctgtgggcagttcatacacccaaaagctgtgagaaggtttattttgtgtcgtaggacaggttagcagaggacaggagacaaagaagacagcccatggagaatttggctagagaaattctctcctgatcccccagctttttctcttgcaaaacaggaggtatgagtgtgttgcactcaatgatgagctactactttatggcttacaacctttcagacacaggtttaggagatgagaaaaacctcagtaccgttcatcacccatcataggcatgcagtgtcatttttatgtgggtgagacagattctttgtttgcttcgcacattgtaatgatttgatgtcactttgcaggtgatctgtttcttaaaaagtgtgcctattgcattggctgtgtgattgcaggcatgttctctctccttcctggaggtggggagccttttggtgacatgcaaggcccatgcaaggaggatggggaaactggcacactagacctatcagtaagcctgggagaagcccagaagagtggtttccattggtctctggaatacagagatttgtgtaaaagcttaaaggctggggtacagttctttgagggaatcgccctgccaaggtagagggtgggatagaaaacaaagatggtgttctctggaacaagctgctgcctccacagccctgacagatgttgagcagccttcatgctctgtctggatagtaagtgggtgtcttttaaatatttgtgtgtaagtttctctctcactaccccttgaactccctgggggcaatgtctgaatcatctttgttctgtttattcttggaagcttccagacatatagaaggtgcacagaaaatccttgttatcagaatgaatgaaaggggagagtgaagcccagggtagttctttcttttctgaggatgatgtttgaatgccttggcatattttaatccattcctacctgaccttttctttaaactacacttaggcctctagaaagtcatcaaagaacattttgctgaagagctgaggaactgatcttaaaaaattagagcttaggtttccatataatgataaagtcagagcttcatcaactgaaaagatgctagaaagatttggagacactctcgccagtatcatcttccttaaccagcatgggctttttgctgtggcatctgttaccccgaaacgccatgggttgtgctaacgtagcccgtcaagttcagtggagggcgctgctcagatatccctaaggtgttcagggcttagctctcccaacctggattcctcctgtgcattcctgactccatttgaccctgtcatgttgcagttaggcccgatcaataatcttttaaaataagctttgccctttgaaaactagccctaagcactttgcattcctttctgtttgaaaagttcagttttgttccatgctcagttctaaaaataccctagagaggtgggaggcccacgccatgcagttcaaagctgctccagtgggtgagggtcttcagggcttggcaatgagctcacttgggtgaatttatcaccttcacactttccggaaatgggctcccttagagacaaaataggaaagtgagcattctgtcccctggcaatctcaggtccatggacaggagggctctgtgctcggaagatgaggcaggcaccaagaccctgagggttgctgaagagcctgagttgaaaatggccctcaaaaattttgttttcaagatgaatgcagtgtgtagacactattgactgcaggtcgattgataatcttcagtctgcgtttttgagagcacctgtagagatccagagtcaatactcactgtgtttggggctgggatgcttggtccacaatgatgctggttatttggttctcagcattcccaagatcaaggaatcttgtcccaaagccccataaatgtaagacagtttcctggtgtcagtgaagtaatacatttgttccctttgcctataattgtcccaaagtggctagcagaggtctaatctctgtttttactcgatgtccttggagaatgaaggcacaatgagatataggctgttcaagcactgagctttttacactctgtttatctgattcttctctctaattaaagttaccttctatacttgattggtttttaaagcccaatatttggcaattaaaccttctttattctaacaactgtgtgacatttccctgagtgatttagcacatgatatattatctgcagaaccaaagactggcttccttggggagcttcttttgcagaatttgatgtcaggtgacttctctaaacatccaccgagcattctgcagagagaatgatgcagactctattcaggagtccgtattgctggtgaagagagagccttggcttgaattcggactcaggagaccccatttaatccccaaatgaagctacttttctaaagccccctcgaggtatttgaaagtgcacacctttttatctgtgtctgttcattataaccaaggaagcatgaagggtgtccttggagaagccagcctgtgcccaccataacagcagtttagcccactcagcccaggccccaggtggggtgctagaggctcttggagcacagagcgcttccaaatagggctgtctgatacaccaggagcaaattatttcgacttaacccttcctagaggcctagtaaaaccacctcaaggttttctttctcttttttttgtttttttgttttttttttagacggcgtcttgctctgtcactcaggttggagtgcagtggcacgatctcggctcactgcaagctccgcctcccaggttcctgccattctcctgcctcagcctcccaagtagctgggactacaggcgcccgccaccacgcccggctaattttttgtattttttagtagagaccgggtttcaccatgttagccaggatggtctcgatctcctgacctcgtgatctgcttgcctcagcctcccaaagtgctgggattacaggcgtgagccaccgcacccggccttaaggttttctttattccattttctctcagacaggaaaacccgtggcaggacgcacggggggttcagcaggcacagacattgtaatacagcccctcccctttccttataagagtggatcctatttcctattcaggtttgttcaatttttgatggacagagttgtagtgttgccttttctaggccataggaaactttcagctgccataggaatgagggtgcgaagcagatagcagccactgcacagaaaaagcatcagtgtgctcaatacttcctccccacctcactcctgctgcacacacacttgcacacatgcatgcacgtgtatgtatgtacacacacatacacacacgatgcctgcacccacgcatgatggcggccaacctgaaccatctaggaatgcacacagaactccacctcctgctctgttgggaagtcatcttctccaaatttagcatttgaaccgaaatttagtctgtgaccatgacccttccttggagcctggtccaaccacataggcattctttatttgtttgagagtgttttcagtcttttatcctcacatatgaggtcagagtgatgctgaagggaggttaaatcactgccatcaacagcattggattcgcttagaggtgattaactctgccacctgccaccaaggactgcagagcgcatcctaatgcctttgtgtttcctgtgctgtgaatgcaaatgattttagggggtttctcctagacttgttgtcctgtcctgaggactcccctggggaggataactggagctattgaagacccgctgtagtaattctggtgtgtttgtaagcttcctcagcaataattccctacctggagctgaggtgtccccctgctacctggagtacttttgcatctgagcatcactgtttttgccaggtggaaggctggactggtgtattgggatggctcagaaagcaagggcctgcaggaataatccctgagactattgatctgggaacttctggctgagatcgttctggggtgagctcacaggcttgggcagtcagagctagaaagggttctagtgcctccttacttaaagtgtggcctgaggaccagaaatagcatcatcttggagcttggcagaacatagcaccttagaccccatcctagacattctgagttcaaatctgcatttgaacaagattctcaggtgatctgtaggtatgttccagtaaacagccagtcagtctgtccctcatcttatgagatattcttttgactgtccttctgagatacattgcaccaagaaaatgcccacatggggaagagaaagccagccagtcagcgagaagttgctgcatgaatttctgactcaggtttctgggtggtagaagaccctaggtacctagcaataagcaaaatagatggatggcaagaggggatgtagagagaaggtctgcacaaacttcaccttctctgacattcacttctcttcttcttccctacaaactagctgccagtgactcactgtcaggtgacctcagccagtgactcgtaggctgggtgatgatttcaagagaccctggtctctaagaaggtcatgatgtaccctttttcctactcctgccatagaatcaaaaataaaataatagtacattgcaaaataggttattaaaaatctaataggattctgattttctcctggatgaatattttgattcttgctttaaaatagcaaatgctagtttagtgtatgagcccctgatgccctccctaagcacatactcagcttcccactgggtgccaggccctgcccttgctgtagtttgaggagacacattcttgagactagatgaggaaaatcccgactccatggccccctaccaattacagagctagttgatggtagattgggggtcagaacccttgtttctggggttccacctggattcttaggtcacaagtagtcctggttcacctgggcaaggtggtatcctgaaggaatcctgaaattttcttagcttctaggacttgacgtgaactaagacttggggtttgggcttgttttttctttttcttttttctttcttttgtttttttgagacagggtcttgctctgttgcccaggctgaagtgcagtggtacaatcatagcttactgcagacttgacctcccaggctcaagcaatcttcccacctcagcctcctgagtagttgggattacaggcataagccaccatgcccagcaaaatcaggacttgttttgagtttatccatatcttagcctccgggagctaatgagaaacagatctgactcagatttgaaataagctaactatacattcaaccaccatcatttcactcccatttgccatgagcgagagggacaaattagccctctgaccaaagtggtgcaggaggtcagagtggatcagagagaagctgccctcccaaaggctgttttcaaactatcgtctgccactgtttcttgctcaacgctgaatcaaggttaggattggaaggaatgaggagggggtttaccattgctgttttttacttttaaattgatttttgatgaacagccttctctcttatgcctaaatagccagtttaatcatcacaatgtcttgtgggagtaagaagcttctttttttttttttttttttttttttaacaaaattccattgcattttcttagcgtagttacagttccatattagggttacatatgtcatgcttcttccaggaaggtctgaatataattaagccttgtgctgtgcctcacatcatgccttgcaaggagaaggtgatcaacattatgtctgattcagcaaaaggcttgtagtaccatcaataacatggtttgctgcttcaaaagtggcaatcagaaaagtctctctccatcactgccttccagatgttaccctagtatacctgggagtttcctgggttatgtcatgtgactttttcaaaatgctcaagaatgtgtgaaataccccatggtgccctgacctttatgattctccttcactgcaatacttactaaaactttaaactacagtcattgatcattctactatccactgggtggttactatccattgccagccctgtgctaaccactttacttatattaatcctcacaataggctatggacaggtacaattactatccccattttacagattaagtaactttcccaaggtcacccagctagtaaatggggaagcagggatttttacccaaagaagtctgtctagaagagtccaagtgattaactaagcactgccctaaaggtataaacagagagacccattctctcttttgatttctgcttttgtttttgtttttttttttttgtagggggagggagtccactccgatcctacatggtggaacaggtttctgactatgaggaaaagctttggggtataacatctaaggcttcattcatgtggtatgcagttatttaggagggatttccttctaccctggtggcatgacaatctccaattcctttggttagcaaaataacaagactgtcaggtgttttgttagcagaaattatggacttcagtgaaacatttctctgactttccagttaaagaatggtttgctcagagttaaccaagacctgagagttggaagggaatttaaaggcccttttgttcaaatccccatctaattcatggctccttttataaccttccactgagcataatgttgtattttggtttatcttttagtcagtcaaaggggaccttgtgcttattgacactttcaatgattaaaataagaattctttttatttggtcttattctgaatctttaacctggatttcttgtctccatcttttctccccttaggccctatttgtctgcttaacatgagcatctgggttaactatatccacaaagaaatctattcttttaattatagaatgaacaactatataaatttacattaacccatccccgattcagaattttagaatcatcccttttggtaactcttcggtgaagtttgtttcagctactaattttttttcttggaagtagttacgtcatccattttcaaaaagaagtcatatgtactcaacagaaactctttaattacgggtgtcagtatccatctttgtctggtctagagtggtgcctttcgcattctactggaaggaatttctcaggcgcatggcattgtatttttacctcctaggcccacctcacagtccaaatgtcagcactttatggaaagagaactgggctcaaagccaaaacaactgagtgagtcccaggttggattctgccctaggaccttggtcaaggcattaacctttgggaatcctggtttcttcttgagaaaatagccactctgccagctctgcccttgtcataaggttgttgagaggctcaaaacagagatgtatgtcagagcacttagtaaactgtaacatggtatggcaataggaggtcaaagcactgggttcccagaatgattacgatgtgggtatgtgggaaccagagaacaagaaagccccacagcttcaaccccacagtggattcttgtccttctagagtgagtgtctgcagatgtcttggcaggggagggtggttggaattaagttgcctcagagattaacgttcctgtcagtcagaaatgtgtcagtcagggagtttcaaagcaacaggggggagagaatgagctgacagtcatttgtaaaaatttaatgagcactaattaagcatcctgtttgtaaatagcaccaaagatagcattatataaatgccaacctggaccgtttttgggaagtggcattaggcacaggtgagctgctctggttagcactgtgccttgcctgcaacagctctgagcatcgatgggcaagggtcttatttatatcttttagaacttttccacaacagactagctctccattgaatattatcttatcaaattatgtttttctcaagattttgataaatctggcaccatcccagttctaagaccttctcttgaaagaagccttcacattaaagacgtcttcagagatcctcttccttctccttgttcccttcacgattctaaattaatctcttcctctttgaagtcttattttttatgatgcgttttaaaaagaatagaatttcatagggaagttgatgaaacaaaattcagccaaaaatgcatttagcacttaatgccataaatatttcagttgtctttcccatcatccatctcaatggatggatgttttacttatatttgtctgaaaaataatgattctgtcagttatcaataatctttaactttatgctaaagaaactcatcattatctaatgagttttgccctttgcggtcatcagtgccagtgtccttggaggaaactcaccaaaactgaagtcagtcgagtcagacctgagacttaaagacctaaaagcagagacttcctctatcctggtagcaacaagtaaagaggggaagagagaggtcacttcctagaacagagggcccctgaaagattgttttggccaattctctgtttctacataggatttctcattcctcattcctgagcaattgcttataggtacactggtgtgctggtaagtgttgaacaactagttctctaaaaagaaaaaaatgtgtgtgtgtgtgtgtgtgtacatttactgtgtattttactgatagaaaagatgtgtagtgtacaatttacaaataataaaatattcttttttgaaaattccaatggattctcacagaatgcttttgttgattttaccaaaatttgtattaatagtcaacatatggttgtaattaacaaatgagtatagttccaacatcaatgttggttggtgtttttgtttacattgacaagcaagacaacagtgaaacaacaaagataaatgtgggaactccagcacgtcgttccacaaatcccattttcctagagttctgaggaggaagaagtcattccccctacacagaagtccttgtgttgcatggtaagccagtcctctgctttgatcatgagaccaggtaggaaaatattatcaagacctgtaagaggctggggcacttgaagaactgagattcattctttctttaagttctaacatgttatcaaattttatacatgcccattgtttaaaaaagcaaatagtgtataaggcttgtcgtgaaaaacagtagtcctctaccccttaccctccatctcctctcagcagcgagacgccctttaactctttcagctgttttaggggggcatacagctagacttctgtaaataatacacttgtgttgctgtttcttgatttgccattttaaaccctttccatggaattcccactatggtgaggaagtgtgggaggcgaggaattggttcactccactcgcattctccaccccacccctgcatctgcatatgtgccaagacatgcctttaatttctcttcactcttccaatagagctaaattttaatttcattcaaatcaatattcagtgtttatattatatagcaatgcaaatgatattcatgactaagcctttatttttcctttcatgaaccatcttttattttccctagaggttttgctttgtttttgttttgctttgtttgatatttacatttagattatattatgtccttttatattagcttagtttcctctgattgtatcactgtgtcaacctcagactctgccagttgtctgtatttctaatccaagtatcagaagcctctgccatcccaccaatctcatcttcaagaaatctctcctggagccctcttccctgctcccatctgggtgggttgtcctctggcatcctgggccctgccatctgcctcatctcgggaattctctttatctggctgccctgtgggttagacctctgtcttttagtgtccaaatggtactggctggtactgaaggagcccctcctcagtcagcttcctgagaaagagtgcagaggagataagacatttgaggccctgcttatctgacaaatccattattttaccttcatatttggtagtttctctgggtatagaattccagggtgcaggctgggcgcagtggctcatgcctgtaatcccagcactttgggaggtcgaggcgggcggatcacgaggtcaggcaatcgagaccatcctggctaacacggtgaaaccccgtctctactaaaaatacaaaaaattagcggggcatggtggcaggcgcctgtagtcccagctactcgggaggctgaggcaggagaatggtatgaacccgggaggtggagcttacagtgagtcgagatcgtgacactgcactccagcctgggcgacagagtgagactcagctcccccaacccaaaaaaaaaagagaagaattccagggtgcaagtcatagcccttcagattttggaagacatcactccattgttttctggtctctggtattactattgagaagttcaaagccattcagactcatcatctttggaaggggtatgttttatctttctctgtctagaagcttgtttgattagaacttgtcctatgtactctaaaatttcatgacactgtgttatggtttgagtttatttcatttgtcttgcagtatgaactcctttaatctagaaattcaagtcttttggtttagggacatttttttgaattgttttgtggttaattttctttcctcctttgtgtgtgtgtgtatttgtgtacgtgtgcatatatgtgtgtatttgtgtatgtatgcatctatgtctgtgtgtgtatttgcctatgtatgtgtgcatgtatgtgtacgtgtgtatttttctgtgtatgtgtgcatgtctgtgttaatgcttgtctgtgtatgtgtgcatgtatgtgtttgtgtttgtgtgtatttgtgtatgtgtgcatgtgtgtgtctgtgtttctgtgtatgtctgtgtatttgtgtatgtgtgtgtttctgtgtgtctatgtgtgtgtgactgcgtgtgtgtgactgtgtgtgagactgtgtgtgtggctgtgtgcatgtgtgtgactgtgagactgtgtgtgtgactgtgtgtctgtgcgtgttctctttctggcactctcattatttacatgctgggcatcctggactggtgatttgcttttcttatatttcctgtcctattttctatctctttatcttataaccctctgttgacttttcccatttctactataatctttttaatttcaccagtcttgttttgctatcataatttttttatattatccagctctggttttcacaaatgtaatttatcttcttttaaatctctcagcatattaaatatattctgaatataaaatgtttttcttacataattcttatttggttgcttttatcccgtttgcttgatttgattgccatatttaaactcagagatttccctcagatgtctgtcaacactagtttctgctcttagtaagagtaggacactagaatgctgtttggaagccctgagcttgttgttgggacgtgtcatctgtaggcttcagtgtagggtgtgactggacgactttgttagagaatcttgtggtcagtacctttaggtctttccttttgagcttttcaaatccccttggaaaagctctcctagttacctgcttagaggtataggcctagtggccatgattctggcaatccaatggggaaagagtttggagatctcggcattttggatacaaaaactcactccttcctacacttggtagtttaccctcctcctctaactgtgcctggtgtccctggaccgggagtctccatttctccaattccagatagtaaagaagcctttggtctcttgctggatatgggaaggggatttgtggatccagctgcttcttgaatgaactttcatcaaggcttctttgcttagtttctcgtccctcccaccaacactcctagagatagcacaatcaatgcctaatcctttttaggagttctgggaaaatagggctgctgctaggcctccacactatcagttgcggatgcagctttctgatcactgttcaatcaattggctatcagtctagtcatccatttgctgcccagtatctaaaccgctgttgctgttgtttgcttgcttattttctttacccttgcacattaatgccccctttcctcctgtagcatctcgatgcacatttatttcatgtcacgtttttgtgttatcgttcattgtaaatctgtctgatcactcctctaaagagggaacacctctgaaggaagcgatgcatccacatgcttaatagttctcagtactcagcaggggaagatcactatgtgctgaagtgtgactaccctgaggtctgttcagtagccgagccaggcctggggctaggtgctgaggctcagatactggtgcactcgtctgtgccctcaaggagcttataggtgggtgctgttttctcctgtccaaccacagggagccaacttctgcctgttgacatcttggtggctaaagaaagaagtgatggctgtaatcgtgagctttccttactctctatttgtcatgaaaaaagacacagaaaaaagtgaaagtcagcctagaaatgaagagacacgtcattctacagactgatgggaaaaatagggctggggaaagatggaagtcaagagactccaacccctttccatatacttctttgccttctttaataggaaatactgtttcataatttcaaaagtaataccagctcaatgtgggaaatttgagagataaagagaactatgaagaaaaaatttagccagatgctgtggctcacacctgtaatcccagcactttgggaggacgaggtgggtggatcacttgagcccagcagttcaagaccagcctaggtaacatgataaaaccctatctgtataaaaaatgcaaaaattagctgggcatggtggtgtgcacctgtagtcacagctacttgggaagctgaggcgggaggatcgcttgagcccaggaagtcaaggctgcagtgagctgtgattgtgctcctgcactccagcctgggtgacagagtgagaccctgtcttaaaaaaaaaagataaaaaggataaagaaaaaatttaaagttactgttaaccagaccacttttaacattttattataaatatttgcttataggcacatatacatatatacacacacacacacacacacacacacacacagacatatataatttaataaaattataattttgttaaactatacctcctcttatagtttagatatcaagtaattattttttattgattttaattacctggtcaaattttgtccattttaatattttgagatttatcatttttaattaagaactttatataccaatataatggaactttgttgtatcttttccatcagtgtattattttccttttttacttgtattttgacatcttctgacatatggaaattagtattagatttttatgcaatcaaggctatctgtctttctttgcaatgttttcttgctttataccaagaaagtatactgagtagatttcctgaggtggattccctggggaggtttatttctcaaaaagccatcagctctccctgaagttgtttaattaccatttactgggcccccgtttacccagaattctaaggctggctcagatagaagatgtggattgggctttttagagctccagctctgctaaatctgtttattgtcccgtttgccactttcacaaagaggatgggcatgctcactgcaagcagagccagcgacgtggccacagctgtcatcagatctctaagccatgaaaattccctgggagcctcttgggatactccagccgatatccaccttcatttgaaactcctaggatgctccccagaagactcactaagacaagaaatagcaaagactgttctaggcaccaactgtcacccggacagtaacaagtcatttttcttcccttgtagctacctaatgagtaatcatcacgacttccccagactggggctagaagacaaacaatgttccttggagttatgtcctttcatcttgcctgtttgacatccctgttgacaggacacaagatgccaggccagatggcgccaggcacattatacagatgagtggcagcagtccaggtgtgccaggcagggggaggaggcaggggagaaactgggcatttcatcactggagtgtactataaagaacatgtccagctggggtctgtctcttcttgagagcctgagtgactgatgtcccaaacagattccaaaatgcctatttcactaagggcccgggaaaatgaatacacgcatcctaatgactgtatcttccattaggccctccatgaagtgagaaagtaggacatatgtttgtgatggaaagagcactatgccaggagccagaggccctgagttctatgccttcataggatgaccagccatcctggttttccagggactgatgggtttcctgggacatgagatttttcatttttaaaatcacaacggtcctgggaaaactgggatgatctccttttctaggtatttgaccttgactgtgtcatttatcctgctgagcccccatctcttgacatttatccctgctctgcctttaaaaagttgcagtaaacattaggaaggtattgggagacagagttaaaagttgtgtgaccttgatcaagtaacttggcctgtttaagcttgatcttcttactaatgaacacttcatcagattgttgtgagaatcaaatgaaaagtaaaaattatatgtaaactcctgatcacagtgcctggtgcatagtaggtcctattaaaagttataaatagctgtggttcctattttgtagtacattgccaaaactagatgtcattgtcactgtaagagattttggagttaagaaagtcaactctgccctctttgggttggattgctgtttttccagagaggggccaggtggagcctcagaaggctggggtgttccacagcttctagaagagccttttggaggtcaggctctgggaaagtgaggagatacactcagaagctgtcagcactggtctccttttctcctggacatgggtttcaggtctgtcagggacactttcatgctttctgtcagaaagtaaatcatgcagaggatggcaggtggaaaagtacataaaggattatattcaacaatcatttattaagcttcagctttgctccaggcctgatactagttactatgcatatgaagatgaggaagactcattcttaccatatcctcaaagggttatggtcctgctgagtagacagatcaacatagatttagatcacagatatttgtttagatgccataacagaggtgtctgtgcaatgctgggagacccaggggaaatattcactgcctagggtatgtcttgatgaatgaacaggaggtggtggggaagagaaggaggtttcagagactggggagtcaatactcaaatatgtgaggcaaatatgtttgtattgagaacatggggtgattcatggtggctgggggagagaaaggagctatgctgtgtaagaataaatgccaggcttgtaggactggaagatcctaagcagcctgaagggttctgaacaaccccgtgaaggagttgggatttgtggtggtgcaaaaggatccataccagatgtttaagaaggaggcaagaaccagatttctgaattggaactattgctgtgtccacacagatctgtttgtaattatgttcataatagcattgtttataccagcaaaaatcataatgtttatgtggattctgttgagttaattatgcattgatacaacaaaatactgtacagctaattaaaattatattagtgatatatattcattggcatgaaaagactttaaagagtgtgttacaaagcaagacaaagcatttccacatttcacttcaaattatatatgagttttacagtggtgcactgcagccagctcacataagctcgcaagatctgatttgctagcatctctttccaagtccatgttcagtgatatcatgttggtagcatgaaataagccaagtggaagtatttattatggaaattgccaaatactacaaataagggcttaaaaaaacagagagcttgttaaacatctcccagcccaccactgtgtatatataaatattaagagaaaaacctgagcactacttgttgatgagattagaggttatttctttgctcatttgtattttccaagtttttaaaattgacatgcatttttaaatttaaatttaaaaaaaaaggtactctttttttattctaaaagcgccaggcatggtggcttatgcctgtaatcccagcattttgggaggacgagaccaaaggatcacttgagcccacgagtttgagaccagcctgggcaacgtagtgggaccctgtttctgcaaaataaaaaataaataaaaagaaaaataaaagcaagctcactctgatagcagcatcatgatgagggatgggagcagaggtatcaattaggagatcacttaatccaacaatcctggagagagctcatgagaagctgggatagggcagtgagaaaatgaaggaaggggagaattaccataagaggccactctatatacttcaaaactttcgatcattttcaggtgagaaagtcatggagaatgaatacttgggcaatgctttcacagaactgtattagtccattctcacattgctttgaagaaagacctgagggtgggtaatttataaataaaataggtttaattggctcatagttctacaggatatacaagaagcatattggcttctgcttctggggaggcctcaggaaacttataatcatagcagaaagcaaaggggaagcaggcacgtcatatgtggccagagcagaagcaagagagagagagaaggaggtgccacccacctttctaaaccaccagatctcacgagaactcactcactagcatgagaacagcaccatcgggagatctgcccccttgatccaatcacctccaactaggtcccacctccaacatttggaattacagtttgacatgagatttgggtggggacacaaatccaaatcatatcaataaccaacagaaggacaaccagaaacagatttcatgaaaatggggcatccaaggattttaacatgatatagcaaccttaaatttaaatcctcttgcaaccttattattattgaagctgatgacataaaccaaaatgactggacttgaatgtctttgcttttgggagtccctgcccaccctaatgggatatattaagccagtgacagaacaacataagcaggcaagatccattattttcatatatgtagtgactctcacagtgcctggccccaagtgtgtgctctaagaatgtttgatgaatgaagaaataaaaggtgaggcttcctcagtggtgtgccggtaaatgttgaagaactattttcctgatttgggacgttcactgatatttgtggtgtaaatactcctaccatggccaattttaagctgtaagtgtggtcaccaaacttgggatgaggtgaggacaatggggtcttgggagcctctaggagaggatccagcatacaactagaccacttggtactcagggaccacccccaggcacctctctggctggacccaccctccccacaatcacttggagagctctactcagacagccctgcagtcaacccagggcctcagcctgacccttggacacatgtaatgaatgccatggtccttgaattgcatcctggtaacatgaggggattgaccccaaatagggactgcactggtaacaatgggttagggttgaaggaaatctggattctggttctgggtgaccacaggaggtcacaggatgtctctgagggtttgtcctcttgcctgtgtcttggagatagtgatctccacctccccaggtggctgtgagagcagaataaacagggtgttacgagagggagtttcaaagatccctgaaagttggtgtggggccctgaagaaggctgtttctttctctacccctttctttctcctcccctctgcatttccctctattggcctgggctctattgtgtgtgaacaggagccaagtcacctttcagtgccctagggttaggggacatgagttaaggtttcaggaatctcaggggcctcagacaaatcataactaagtgtggagcactaccctcaaagctgataggaaaggggcagcgggacagcaccctcaatcctcgctatagcctgtgacctgccaggcaggcactctagtttcccttcagcagaggtgcatgagctcctcaagaggcagctgggtctccagtggcccataaatgtgggggctgagcctggtttaatggggaagcacttaatttcctgatttatgaggcactcgttatttttattaactgtcctattttattaggcctcattcatggactgagaaaatccttattcttacagttctaaatgccaagttctccatccaggcagaaagatccttagaggtcacatatctggtaaaaagctagctctcaaagtgactagaaggagaatgttggcatttataatgattataataatgctatttaggtgtctacctacgggcctcattctatactgataccatgcatttcatgtactcctcaaagcaaccctacatgatagatactattattctcattgtacagatgaagaaattgaggtctggcaaaggtttacaactcgaccaatgtcacacagctagaaagtggtggcacaagacccatacccaggtcatctgacttcagagtcctattttttttttttttttttttttgagatggagtctcactctgtcgcctaggctcgagtgcagtggcgcgatctcggctcactgcaacctccgcctccctggttcaagcgattctcctgcctcagcctcctgagtagataggactataggcatacatcaccacgctcagctaatttttgtatttttagtagagatggggtttcaccatgttggccaggatggtctctatctcttgacctcgtgatccgcccgcctcggcctctcaaagtgctgggattacagtcgtgagccactgcgcccagccaatccctttcttttaaagaggccctgccatagatgcttggaactagaaagggacttaaagtctctcctctaacctccttgcatggctgcaacatcttagctggttgcttaagcttcccttatcctcatttcctcttctgttctgtagttcagagccacatatgtctatgtctctaagagctgctacattttaagagctaacttcacttcagccataactgagtcctaccaaccccttattatcatatttttcctctgctgagacatggatctggtataatgatttcctcttgtcagatggaccaagggctacaagttgttccacaatatatactcacggggagactgcaaaacgcaaccctctgcgcagctattaaaataacctcccctctgtaatggattagttatttcagcaacgagacccatttgaagggagatcatgagataattgactgtcaaacagttgaacaatgttaaggtcaattgtagtggaggtcaattcgtttgaacaatgggcctgcttctgacaggcttcataatgttgataataataactttggtttaatggaagtgttcagtggtgttagagaagaatgaactattagatgttcagattaagtattgtctaaactcagagggatttggacattgtttggtcatagagaataaaaatccttggctagggaaaaccaactttaaagaacagctggatttaatgtcaaaggcaaatgattttctttccccctttaccgattgacttgaatttacattgtgcagattgcgattattcccctactctatatttatagtttctcatttgcattttccagaataattaagaatttaacctagaatgggccatttttgaatagaggtgaatgctttctgatttttaaataaaccatctaaattagataccaaatatacgttgtattctccttgcctccggcttggagtccttctaagcttctggactcgttactggaacccaaagggagagattgctcaccccatccagaagtctgtttttgtctaggaggtgactcttgttcacagaggacaagccattttgcagatggggtcatctacgtatggctatgtggagcccacagacaagctcagcagcctctttaatgggtggacactgagggactccccagtgagttcccagcagacagcagaagaggagagcagctctgcattctttgcttaaattccactgaacatttccaatctattttgctttgctttccagtgcagactcttcctttgtgcttttaaaggatttacatctccaggaagaacataactctgacactccccgaggtcatgctgccctcaagattcagctgagaagggggagagctaatcctcaggagagtttgctcctccagccagagcatattcatcatcctattgctcccatttaacacaggaaggccaaagctccaaaggtcaaggaatatgtcccacatcacagagtggcaggaaaaactggcaactgggcccacatctatctgccttcaaagcctattcactcttcctatctactttactacgtcccaaatttataaatggaacctcatcattgtgagggctgcttggttctaatgcaacaaagccccctgtctactccctaagttcattctctgttagtgagtagggggctactaaggccacgtcaaccctgcagctgctggattctgcattgctacaacatggttccaagagaagggctgtgttctccctgggcagggggctctatgtccccaggcaggcatgaacagaactgcagaagtgattcattagagcttcctgagaagtctacagccccaggcagttgtttctttccttgggacagaaggggcaggggtaggggagaaccatgagactctggatgcatgtaggtgtgcaaacagccaaaagctctttcagagttcttggatggaggcagagcatgttgaggtgtgttgaggacagctgacctggttttactataggtttttgagttgtctgcaaagttctctgcatggttgggttccagagtttcaaatactccctctacccccaaataaaaattagtagtaatcccaacaataatgtctgtaagccctttgcaaaagagtcaaagaccctgccagtcagacagcataacttgtgaatttcctggtactcacctggaccaggtcattgatcaactagttagcaaagattggggcttaatggagtctgatgggtccattttgacatggaaatgcactggaaacatccctgggaagggtggaccttagtgaggttctacactggaggagcttagccaatgatatttgcacttatcaagcacttactatgtatctggtatagtaactaggactcttaaatgcattttctcacttcattatcactctataagaatgtaagtactattattatcagccatattacaaatgaagaagctgcggccgagagggttaaatagcttgcctggagttgcccagttagtaagtgttggcaccagaagtcccacccactcagtccaacagactctacagataggctgagcatcaggaaaaggaagtgtgtatatagggatgtgtgtgtgtgtaggggtgtgtaggtgtgtagggatgtgtgggtgtgtaggggggcactggctagacaaaaatgttgccaagcatcttgtctggcctgaaagcgagggcagaatggtgtctgagtaaagtacttgtagcttagttgcacttgttgtgacaaaaccaaacaaacaaaactaactttacctctgtgagaatgataggcagaggtttaaaaaaaatcctgtaatacttgctttgttttggcttcaaaagtgctgttgataacagctgttcccagtgtacagtgtgtttattgttgagtaattatgttttgctttcatattggcaaagctattatttgtacccttaggagcagtggacatcatgtatgcacaaatgaattaatgtgacaatggctttcgacgttggaagcagtgacctattaatcttcagtgttaaataaatactcagacctgttcatcatggtgcctatcactactgggtttcgctggctacaaatttcacaagatcatgcaacccaaaggactggaatatagacaaaaagagagaaatcatggacatctctcttgtgatgattttgaaacctattcaaaggccaaagagtgtttctgatttaaaacagccagagtggtcaaagccagacattggaaatttcccagaaagcatgtcaagggaaagattcctgcactgtatcctgtccctagaaggctaaatcaaagtgacattcctctttctccactctccacttacttttgcacacacgcacgcacgcacacatgcacacacacatgcacttgcatgcccagggatctttgatttctctcaaacttccttagtacctcatggaggtctcagtcaatggtattgcttgactgttttattattacttgccatttcctgtatacaagccaacatacagttagctaacttgcccacttagttgactaaacggaaaggcagacagaaaacctcagttaggtgaaagatgatgaatattctcaaggaataggaaagtacaataatgaagaaaaaggtcttgtgtgaccatcttgcagacttgcattccaactggttaacttcagacaagaggagagactgacaagcagggaggagacagcttacacacacagaaaagagatgggaaaaatggaagaactgcgtttaataaatattcttatattcttgtgtcttcattatgtccaaagtgaagtgtggattgtggattgcagaaaaaaaaagcaagatttagcctgtattcccagagaaggcaaattgttggacaggaaacaccgaccctataaagaggcagtgagaggtggctgtgtataaagggccccagtaagacatggtgagaatgaaaggagaacaggctttgtcttacacactcttcaaggcaaatctgaaatgtccagaaaacaggaatttgaaggcctgacagaggtaggaattcattttggctaaagcctttttaattgaagaagaagaatgagagaaaaaagcaggaagaggccagaaaggaggtcacccatggagacaaatgatgaataaggcctgagcagtgcctggggagggaggagggagccgaggagggagccaaggagagggccaggtgcctgtattcaatgcagaaagggatgagatccagaaagtaggccaagggaacttggtctacaaggtacaaatcctgttcatctctgatacatcccatgggcagtgaaaccctggagtcaaatcaccatcccagacacaagtaggccaagcctggcactgagaaaaggtttaaccagtggcttgtcaatgaggtgccatggttgaaccttaatgctaaagtgagtcctaacaccaaggccagcaggcagctgttcctctacctgatgggaaagtcacagccacccccagtgctccccaaataagagtacgtggggctgggcacaacaccttgagaggctgaggcaggcagatcacttgaggaggagtttgagaccagcctggccaacatagcaaaaccctgtctctactaaaaagacaaaaaattagccaggtatggtggcacatgcctgtggtcctagctactccagaggctgaggcaggagaatcacttgagcccaagaggcagaggttgcagtgagccaagatcaggccactacactccagccttgatgacagagtgagactctgtctcaaaaaaaaaaaaaaaaaaaaaaagaggatgcgggtaaggtgtgaatatcatctcttgggaatgggtgtgttttccctcatgaaaagaatgaaggcctgagtgagatcatgtctgtctgtctactactcaaaatcctttagatcaggggtcagaaactgcagctggtgtgatgtgtggctaagaatgattcttacattttcaaaaggctggtataaacaaacaacagcaaccaaaaccaaaccagaatatgccacagaggctgcatgtgccatattcttatatggcacaaaatatttactgtcttgccctttacagaaaaatgtttgctgacctctgctctagtggattcccaccacatttagacaaaatccaaagtttattatggcttactagtggcattggcagattacacacacacacacacacacacacacaaacaaacaaaaacaagatgcttgcacaatatttaggatatacttatatgaaaaaatgacttgctttttatctgaaattcaaataaaactagacattttgtattttacttggtaaccttccttacaggacatgaaagggtggtatagcaggagtatgagctctggatcacactgcctgggttcgtatctcagctccgccactcatataactgggtgagtggttaacctttccatgcctcggctttgtcaactgcaaaatgggggtgatggtgtcctctagggcacctggaacagtatgtggcatgtagtaagagatcaggagtaccagctgttactatatcacctgctccaagatgcccgtctggcttttcctcctgctgctccccagtttccacatttcactatagctattgtggtcttctggccattcctggacactgccttaaaggctttgcacccatggcaccctatgcctagaacacttttctttctactagcctacagagctcactgcctcaatgcacaaaggatcctgctcaactgtaactcctggaaaggcctttcctgctctctctctagccccctttctgctttcctctgtcatcacagcatttacctctccctgatactgtttatctgtgttatttgctcatggtctgctctcccacggcaatgccagcttcctggagtgagagtcttagtgatcttgttctctgtaatgttcctaatccctagcacagtgactggcacatatttgaagaataaatgggccaggtgcggtggctcatgcctgtaatcccagcactttgaaaggctgaggcgggtggatcacttgaggccaggatttcaagacaagcctggctaacatggtgaaaccctgtctctactaaaaatacaataattagccagtcgtggtggtgcgtgcctgtaatcccaactactcaggaggctgaggcaggagaatctgccgggaggcagagattgcagtgagccgagatcgtgccactgcatgccagcctgggcaacagagtgagtgagactctgtctcaaaaaaaaaaaaaaaaatcaatgagtaaatgatctactgtactttgctaaggggcttgcttcagagtcatggaaatagttataaagacatcaacacagtatatagaggattgactacatgctgagacagggtagtgaataaacagacagggtccttgtccccttctgagtttacaacctagctgggaaggcagatatgacacagatacttaggactgacaaagtataaaatctgaaaagagttgttaacaaaagtcctgggagtcttgagagcatttaaaaggtccggaaggtcctcccgggaaatggacttttgagctgagccatgaagcaagaccaatttagccaagtgaaaagggggaagaagagaattgtagtccaagggaactgcatgtgcaaaggcctggaggcggggtaggcccagaatgttcaaggagcataaaggagtgcagggagcccaaggatgtgggctccttgccactgtgtgtagaaacctattagtcccgctcagtgctcgggctttttgtgttctggcttgatgcttacatcagcacaactgaggtgcatctgggccaacggcagcctccttgcatgtacttattaaaacttgggtttgttattcttttcagttcatttaagcactggcagaaagggctgagctgacaggtctgaagactgatggatggatgggtgatgcggcacaggtgcttgaggtgctgcgactcttttttgccactccctgtttggcagtgacagccccgcaggaacagcacagccttgagtcagccctgggtgtcctctcattggcaagctctatgagcctcaatctccccactaacaaaatggggaggtgggtactaatatgtgcctcgtaaaaaacaagataattagaagggatataatgtgctcagtttgttgcctggcacatgcaggggaccccggaatggtgagcctgtctctcattcctccctcttcaaacccagccttcttctactcagcggaatccattccagagaaggaagacttgaagctaacgttttccatcctgggccctttgaaattccggttacctgagatagtctgcagaaataggtgctgtggtaaaataggtccgtggagaattcttcccctaaaaccgcaaggttccttcttaaagcaccaaccaggggattttcctcagcccagagccaaggatgtgtggatgtttgacactctagagcttcctggcaaagtcattttgtgatgcagcacaggccctcacacagggccattcaccggcagggactccaagtccatgagtccctttgagtgcagggttgaggtgtttctgactaaagagggctggtcccctggctgcagtgctggtcgccagcttctgcgtgaaatcgccttattgtaggaaacccagagggttcctcactgaccccctactgtcacttcagcctcccactcccagagttggtacccttagagaagctgctgttggaaaaactttataagcattccttcacaggcaaccaagctcagaatcacggtgcttcctgccggctctggggtgggggtcttccagaagaggcttcccatctgcacatccatgctggcgtccggcatctcctgagaccaagagacatttttgtcctgaacacttctatactactatttgtcaaatggatgtagaagctgttgtaggtagaaaaatagaaactcatttagaacttttttctgagaaataatattagtggccactaaggtataaataccaacatgtatggattggcaaatattgttagcctaaaaaccgtccttattcccagacaagtttagagctctactttattattattattattattattttgagacagggtcttgctctgtcacccaggctggagtgtggtggtgtgatcatggctcactgcagctgcaagctcccaaactcaagcgatcctcccacttcagcctcctatgtagctgggaccacaggcatgcaccaccacatctgattaattttttaatttcttgtagagatggagtccccctatgttggaacactgctgtagaatatttggtattcctcatcacagatgaagagactgagtcagggagtgactggtatcatgcttaaactcagtgagggcaagcaggggctatggtatgctagttcgtgaagtgtatgatggggtcacacttcaaactgccctgtcctccttcaaagctccttttgtggggagatgcaggcagggagaaaggctgctatattctgcatcctgctgaacttgctgtggccacccttggatagcctggatttgaggacgtggctttcttatctgatgagcccaatcactcctgcgtttgggctggcagcatcctgcaaaggtgcatggtctagagcagaacagaatgagcactgccttaggagttagaaaacctggattctaacctagtttaaccatctattatccttgtggcttggggccagccaattcctctctttttgttgtttggattttttttttccaacatccacatctgtatagtgcgcggtcggtgggagagggagcaaatctgctttacttttcttacaaagatgctgtgaaataacaagatgtaaaacattttaaaaacattcaaaatgattcagccagactcgggctgctgactgtattttggtgctaatgccaaagcaaacatttccatttcttttggcatgtctagcatcagattcatggcctggaattgtcaaaaactgaccagaaaaagtttcttggagtctgtcaagggcattcagttatggttcagccgagtttaaactttgggaaattgcaggatgaaattggaaattgccctgggtaatggagagccaaattggaccttagagcaggtagcagggtgacttattttttaatgtttccaacatgaaagaacacaattgattttttccctccttaatccctccaactccctagcttttattgtttctaaaataagataaaccaagcaggtgttatttcagctctgtaaacaatctttatttttctggccgataggaatggaaattgagacggagaccaggcttaagagagggggaagccaggcaatcaaggaaatcattgatcttaacttagccagttcctactacttctgcaaaagctcacagtggtcgtgctcccccccgtaacttacccttgggtctttgtcgatacctcatgaaagtgcggagcctccggcagagaaatcttcaagcactctggttccttgcacagatcaaatcgcacttgttattttttaagattagtggcagctcctaaaatgactttactttctcgatccaggcaaataattgtccaaagattttattttaatgcttcagtgctgggaacattggaggagtttctatcttatggcacattctgaagttccccacctattttcttctccttctgtgtgtttctgccacgggcagaactgtgtgacattcaaaggccttttctgagtttgtagacagttagcagggtggagacaaggaagacatgagcctgaatggtcctagtgaaggagataaacctgtgaccctgggctgggtctgagtctgaagattggggtacttgctgctgctagagtgtaggcatcaatccaggaaagccccttcccttgtaccagtccaaaatcttgtgtgtctcagtcttgggtgagtcctttcgctccttgaaaagcagttttggcagagctggctcagatgacaagactgttgctccttcttccaggaaggagaaccttcagggctattctgcagtgtcagtacaggatgtgagagcagaaacaacagggtatagaagctcctcgagctagcatgaggttacatcctgatgaacccatcgtaagttgaaaatagcagaagtcggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaagaaaagaaaatagcagaagtcacaaatgcattgaatacacgtaagctaccaaacatcatagcctagcctagcctaccttaaacgtgctcggaacacttacacaagtttatagttgggcaaactcatctaacacaatgcctattttataataataaaaataaacaaaaaaaggcaaaatttaaaatatggtttctactgaatgcacatagcttttgcaccatcataaagtcagaagatcattaagttatgccatcataagttcagaacgtctttgtagagtacaggtaaggtctttgatgacagacagactcaggttagatgatgttagctttgtgctattatcttagcttcctgagcctctatttccttacctctaaaatggggataatacctctaccactccggtctcaaaaatgttagctacaattatcatcattgttgttttatagtcatccttaaccagtatctctagggtttatgtatattttcatcaccactaattagtacttattggttgaacaagaggacagaatacttgagctgggaactgtccctaaaaatctagaacatgaagacgtggtggacacttgctttgcttctactgtgcctggcaacatgtcacctcatgaaaggtggtcactgcctcagaattgtccctaagtttcggtaaaatggtgcttcatacaagcaggaacctgagaattgggatcctaggctgcctcagaaactagttacctggtgttattcattaactcagagtagcagaaggcaagaggaacagaaagtgcagttattacttgggattacaagaagctgagatgctcacactccataaacacacaactcaacgcctttcccatccccgagaccatggggcaggcagaacccaaatcaaactagtcacgggccacataacaacatttcaggcaatgaaggactgcacatacatcagcggtctcataagctttataaggaagctgaaaaattcctatcgcgtgctgaagtcatagccatcgtaatgtcctagcacaattaatttttttaaaataaatttagtgtagcttaagtgtacagtgtttctaaaatgtacaggagtgtacagtaatgtcctaggccaccctcactcaccactccttactgactcacccaaagcaactttcagtccaggcaagcttcattcgtggtaaatgccctatacaggtgtaccatttattatctttaatgtttactgtaacctttctttcttctcttttccctcccctctcctccccttccttttgagatggagtcttgctctgttgcccaggctggggtgcagtggctcagtgtcggcttactgcaacctctgcctcctggcttcaagcgattctcctgcctcagccgctggagtagctgggactactggcgcaggccaccatgccctgctaatttttgtatttttagtagagatggggtttcaccatgctggccaggctggtctcgaactcctgacctcatgatccacccaccttggcctcccaaaatgctgggattacaggcatgagccacaagccaccacgcccggcctctgtcattctctttctttctctttctctctttccctccctccctccctttcttccttccttccttccttcctgcctgcctgccttccttccttccttccttccttccttccttccttccttccttccttccttccttccttccttccttcccattctgttccgttacactccactccactcaagcaatcaacctgacctcaagcaatcttcccacttcagcctcccaagtagctgggactacaggcatatgccaccatgcccagctaattttttaatttattgtagagatggggtctcactatgttgcccaggctgttctcaaactcctgggctcaaggagtcctcccaccttggcctccaaaggttcttgaattataagcatgagccactctgcccagcttagtaccttttctatattttaatatgtttaggtcacaaataccattgttatacagttgtctacagtattcagtacagtaacatgctgtactgtggcctggtttgtggcctgggatcgataggctataccatatagcctaggcatatagtaggctaccatctaggtttgtgtaaatgcactctgtgatgttcacactgtgatgaaatcatctaatgatgcatttcttagaacaaatccccatcgttaagcaatgcattactatacttctcgagtcccatgcaatcatgccctcggcggatgtgctgtctgtctggggcagctgttctctgcctgctgcctctttcctgaaatgcatctctaggctgttccttcctggcagggagccctcattagccttcctggctaatgctgctcttgagataatgacatgaacctgctttcaagggtctggagtgttttaggggaggagcactgcacttctgattaccataggtccaggtagaatgtgttcctattccgtggaacaggaagactcaactcatttcttctctccctgtcttgataaatttggggaagatctcaatgaacaagtgtctctctagtttccatatattatagataagctgttcggctaaactgaagttgccttatgtgggctaataaatggctgggctcagggggttggagatgctgtgggctgtgggggagccatgacctcctttgctttggggactgagaacgatgggcccaccgccctatggagcagcttccctcctgctcagcaactgttaggcctttccttgggtttgggcctgaggtcttccctgtctgagacccctgggtctagttggtcagcagtcccacatgtctctctggggtcctaagaatatttatttaaaactattatctattcaggattaaggggcctttcctttggagtatttgttctctgagtgggtgcttagcaactgaagtgctgtttgtaaaagacataggttggtgtccccaagcatttcataatgagtgtgggttgaaaagctcctctggtgatttttaaaaggttacctttcatctatatcacaggttctcagagcatgacctccaaaccaccaatgttagcatttcctggaaaactggttagcaatgtgaattcttgggctccaccccagacctactgaatcagaaaccctggggactgagggcagctctttgagctttaataagccctccaggtgactttgatgtgccttggagtttgacagtcactgtcctaagtggtcaggaggcgtggatgtcaggtatttctcttctgtaacaggccagaggacacaccttcagtatgatcattcaagagatatgttagtatctcttactttgggaggccaaggcaggtggatcacttgaggtcaggggttcaagaccagctggccaacatggcaaaaccccatctctactaaaaatacaaaaattagccaggagtaatggctcgcgactgtaatcccaactacttgggaggctgaggcacgagaatcgcttgaacccaggaggcagaggttgcagtgagccttgatcgtgccactgcattccagcctgggtgacagagtgagactgtgattcaaaaaaaaaaagtgatatgttagtatctcttaaagtaccatcgactaagcgccttcttctgaatcactgagggatacctattaaatatgtatacactatggtcccatttcagtttttctgaatcaaaacctttgaggttggtgacctgggattgtgtctgttcaacatgcttcccacgggcttctttcacccagtgaattttagaaataaccttcctattcaatgtatagtgtttgaccagcggcatgttcatcacctgggagcttgttagagatgcagaattttaggctccaccccagacacttaatcagaacctgcatttccaatatgatcaccaggtgattcatacacacattaacatttgagaagcattgccaagggccatatgcttagagcacttgctatgtgtgggctgctgattcatagtttagtcaacacacccttgagtagaaagtgtcattctagggtagaccaagggctcttaaaaaagtactagtgtcccatgggtcctgactcagacatcctggagcttgtccaggatgtgattaacagggtaacagatgtctttgcaaagcactggagagctgatccacacctaacgagtgtcacatcaaaggcaccatgtggatctcttgttgtgggtcttgcaacccctttaagaagggaagtccacttgaccgcccttccaaactgcttttttgttttcccagaggagacaggtaggcaatctcatcagcttagatgatacctagctcagagaagcagagatttaggattcacatgactcattctttcgttgctagttagttttatgtagctttccagaaaggtctgcccactgtcctttataccttagtgtgagttgaggttaatttatctttcctttggaccttgccactttagaagggaaagcttgacaatgtgtgccatgacaggctctagacttccatcaaaggaactttaggcatcaaaagcagatgaaaaggtattggatttggtggtgggggaggggctttctaggaacccacaagaaattactgacttgtttctcttttatatttctgggaggaaaatgattgggccaaatggtctctggggctctttccattactggaaattctttggagtatttattgagcattcactctgtgctaggtcctgtgctggacattgaggggataaaaatgtaaactgatgcttctacctgtctcccaggatggggtgggaagggagacagagacatcagcccctctctgaggtccaagagatgctctcctcctgtcactccaaaaccgatgtatcctgatggtaactcaatagtaaaggaaacttccatttttattggtgtgagtaaactcattcattcattcattaaacaattattttttaatgtctcctacctgtagacaattgtttctgaaatttgtttttagatttgaatatgaaaatgatctttcttaagagcacctgtttcaaagataagtttgtaaactttcagactagttggaacatattgttgtgaataaagccctgattagaggagaagaaatgggctgttttccctctagttttccataggacagtttgagagaggtcaagctggagttttaattgaggagggcttttccatcagtcagcactggccactcatgaaatagagtgacctcccccactcaacaaacacacacacttggaactagtgaaggaaaggtcagatgtcattgccaagggctttgagaagggacctggacttggtggcttcctacagtactttccaaccttgagattctgtgaggaatagagggctgtgtgagattcatctcagggactgtggtttcttttagcataacatcctcatggcttatttcgtcatgtttctgcacaaacattatgagtagaatggcttgcatttgcctttctaattttctctcccaggtgaaaagacactaggcatatggttcaaacacaatggactgatagaaaacatgaaagttagaatgtaacagatatctcaaaggtagcacctaagaaaaattacaggcactttcctccccaaactggactaaggacctagagtttcagtgaatcccagaaaatgtcaggtttctcattaacctttctctaagttacctaaaccatatcacaacccacaactaagggaaatgctggaggtggcatgagagccacgtgctacattaaaccctatgcctgggtagaaaactgagaacttagaataatttagatcaagtcaccctcttatttaaagagttcaagcaaagccaaactttgttgcaccattccctatttgtattctgaagattcaagaggctcacaaatgctgatcctataatttgggtacctgtcaccagcatgcatggacctagtccaaacagtcctttgtgttagtaatgtgttgtcagagagtcaagtaagcaattgtcattttccataaaaattaattgtttaaaactgatctctagctacattttaattttttttaatcaaaactttaaagaaacccatagttggcagtattgcctaatagccgatagagcaggctgtggagtcaaacagatctcagtaagaacctttagttttgcttctttctagtggtgttagcttagggcaagttacgtatcttctctgaacctcagtttcctcatctgtaaagtgggaataattgtaatacctatgtcacagggttgttgtaaggaacagtgagataataatcataaggggatggaaaagtacctgatttatacttaagtgcctcattaagattgctattattatacctgatttttccatagtggggcttgagagtgtggacctgtggtcctagcattctgaggtaaaaagtagaagctctacagatctcagggtttttacagtctaggatcattccctcattcagtcatttgtccatccaacaaatatttatttagcacctactctctgccaggcactatggtagcagtcagacaataagcaagtgactaagcccgtgtgtaattattggttgggatacatgccaggaaggaggcaaaccatgggcagtgatgggacatgctgctaagcggggacctactttgataggataatctgagaaggactttttgagcaggtgacatttaagctgggtccaaaggatgaaaaagattgtgtcaggcaaagaaccactgatcctttcattagtgcataaggtagacacgatttcaccaggagtactccaaacaaattgagagccccagctttcttctcatctgtacaagaagtagaccttgccagcaactgggagggaaggttttgctcattttattatatatggtggagggttcatttatatcaaacttctctagagcccagcattttcaggggtgttgtaccagcagggatacagtttcccacctcagtggaagctggcaggaagttgcaggaagttatgaaaagagagtgagccttcagtccagatctgggataaaatctacctcaaccacttcctaattcagtgagtttaggcaaattagatgatctctgagtctcagtttcttcttcggtaaaatgtgagtgtgactgctgttgtcaggattgaaactgaaatgaaatagccatacaaaccattcagtctagtgcctagtatatggtaggcacagagtaaagcacactttcctgtggggctgtgtatttaaaacagtgaaaatcgattcctcactttctaacccatgtggtagaaaaagacatctttggcatacgtggtggctttaaaacaggtccacaaattctttgacaccccttccattcaaaaatagagtcgaattcccttctccttgaaaatggacttgcctgggtcactcatgcctgatgagtagaatgcagtggaagtgacactggatgagttctgaggttgcgttggaaaagctaatacagcttccatctgctctctctctcggtaccccccatcttgaaaccgtgttgtaaaaaagccaagtggccacatggaaaggcctcttacagatgatgttccggctaaagccccaggtgagatcccagccaagagtcagcatcagctcagaaggtcgaggctgccatgagctgtgattgaaacactgcactctggcctgggtgacagagagagactctgtctcaatcaatcaatcaataaaataatttcccagaaaagtcagttaattaaaaaaaagtcagaatcacccaccagatatgtgagtgaatgagccttcagatgattccagcccccagcctttgaatgacccaagcgagctagagttgaccagagacaagctgccccaaccaagccttgcccaagctgaagatttgtgagcaaaataaatgctgtcattgttttaagccctaagtattggggttgtttgctacacagcaacagataactagaatagcacacttctttgtctttctccaacccaccccctgccatagtgtctctcccaccactgtagacccagagtagcagagatattaggaaggacactgtaccatagtgggatcttatttcttccactaacatcctgcaaagtcttaggcaagtagctcctcctgtggggcctcagtttcctcctgtgtgtggtgagtttggattaaatactccctaaggcatctgctagtcccaaggtcatgtaggaaactaatatgaaaataggaaaagttgcaagatttaggtattttgcattgtaggcctaagttttgcatgcagtggcatggaaacccaatgttctctgagagccttctttgcaacttttcaattaaagaaaaaaaaaacatggtctaagcatttttttttttatttcagagggagattttatgtatctcgagacctccatgtgaaccataaaatgggcttggttggagccttgcaggcctgtcctgatccaattgtctagcaattctcatagaatcctcattagaacctgtgccctaaagaagcctgcaaacctggggcccatttaacacctgcagttctcttaaagtttaaacaaagactggcaggcctcaggctaacagagttttaagcccccatctgttgggtggtttctggcagatggtctttaaaagatgctgtgtgttttatcatttcagtttcttctgaagagggatttaaaatcaatttaagggtcatgttcagggactttgtcaaaagtacaggctccacgtcaaacaggaatccgtcctcaggggctcactaatgacaaaaggaaagtgatccgggctgttccatggattcttgttctcatctccttcctttgtggaggggatagcttttcttttgaagtctgttgcttccttcatttagtctttaattttataccaccaaggtgagtactactctgtcttatgtacataactgactgtggtatgggagacttccctgatgagcaaaggccagtctgaaaagggctggcttccaggtttccaagtcgaacatcatactctaaatgaaacagaggaaattctcattaagggaaacttctgggtaagctttggcgggaagaagaaatgaaaaattgtagaagctttagaaatctcagctagcttatgcattatcaatatggaaaaatggattgttgctttttccatccccgctcctacccatggataggggaatcatgaaactcaacatcagaaaaagtaaataccaagagcccagaaagagcacaacttgtttttcttggtctgtttaaggctgctgagattgaattgtatccctaggatattggagtttttcttgtctattgcctagagcctggccattattgtgatatttggctgagacgttgccaaagtacaagaagtgtttgttattatgagtccttcactgaaaggtggctggcacatgaagggccctattcattgctggccgttgcagctgttattttggtaggggctgcagctgtgtgtagggaaggctcttgctctgggctgctctaggtgtcttagagcaaacaaaaaggagggaataagctcttcaggttgtagttccactttggattgcaacctaaggcatgcttgctcacctggctagaatgggagaataagtgaggtttggcatgccagagtctcctgccaggggttccctggccctgagctatggttgctggtttctgttggatagatcactggactaatgtgtcagtgcctagtgttggatccctggctaggtggagaatctaacatacagatataaagcctgtaggggaaatcagagccaggaaggaccttggcaatcaattggcctagcccctttctattatgaatgcagaaactaggcccacagccatggaattctttccccacagcctgtaacagaggcaaggccgcccatctcttctctcaactccagctcaggtctcagtccaggtcaagcagcctgtgaactcaggcccttggtcacaagggtgttcagaagagggcttagcaccattcgcccatacctactgtgggaaaagcaatgtagagtgcttgccctgctgatgtttatcagcaagcctgccttaggattaagatggcatctcacctaatggacctgtccctgcattttccctccagaaagagggccttggacaagatgaacctccctgccctgttcactcgcagtcacacaggccctgcctgaggtgaggctgaatagaagcgaaggctgtcatgagttggaaatggcccccattcccagggaagccctgtgagcagtaaagttgttagtgtgatgaaggccaagatgctcactgatgtgggaggcagagttcaggtttcattattgaaatgtccagattttttcatgggtgattgaaaccttcttagtcccagcactttgggtgagtaattctctctccccagctcctcttcttgaccccatttggaccccagtcacgtaactgccagcctttacccactagggtccctctgaagctgcagcttggatcccatgtcagagtctatctatgtggcaccttcaacttgccccagagacttttgtaaggggatagaggccaaagaggcttttgtcttggaagaaccatcacaaatgattctctacttctaagaaaggggttgagcttggttgctgtcagcttctcattgactaggtgatgtcaccaggggagacatgggctggttcacttcaataaccaagcagctcaacttaaaagctttgaatggatctgacctcttattccagattgtttttgtgaagattgattagcttcagtatgcagattatataaatttattttattttaacacacgttatgttttagagcagttttaggttcgcagcaaaattaagtggaaggtaccaacatttctcatatattccctgctcccacaatgcatagctcccccactgtcaacattcacaccggtttggtataatttgtaacaattgacagacctatgctgacacagcattatcacccaaagtctatagtttacattagggttcacttttgatgttgggcactcaccgttatagtatcatagagagtagtttcattgccccccaaatcctctgtggtccacctatttatcttccccacccctactcctaacccctagcaaacactaatctttttcctccatagttttccatttctagaaggtcatacagttggaattatacagtctatagtcctttcagattggcatctttcatttggtaatattcatttaagtatcttccatgtctttcatggcttgatacatttctcttttttattttactttatttttttctgaggcagagacttgttctgtcacccgggctggcatgcagtggcacgatcactgctcactgcaacctctgcctcctgggttcaggcgattctcctgccttagcctcctgagtagctgagattacaggcatccaccaccacgcctggctaatttttgtgtttttagtagagacagggtttcactatgttggccaggctggtctcgaactcctggccttgagtgatccgcccaccttggcctcccaaagtgctgggattacaggtgtgagccaccacgcctagcctaatagcacatttcttttgagcgctgaatgatatctcattatcgggatgtaccacaattaaataaatttttaaatatcaaatactctatgttagtgtgatttgtctgttttacttgccacctaatattggcactattcataaccattcagaatctaatgcttctctcatttttaatatgttcctttcaatagtcctttgaagcaggtaggaattgtcatggtccaaagataagagaacaaaaggacaaataaccatgtttttctgtctgtctgtccctttgtctaactgtccctctgactgtcctcatgtctgtctttctaaccaccctctgtttgtctcagtgtctgactgtccatctctctctccctctttgtctgtcttcccttctttcatccgttccttttttcttcctttttttcattgaataaatatccgctctcctactatatggaaagcgttacttttgttaattcgtgaagctgatagagctctgttttacctttgtggagcataatagtcaagtaaactggccctgcatagttagggactgaaaacttctcaatgtcagaagtagagacttgaaacaacagcctctgacctcacatcagaatgcagtagctctctgaggttctactaaactagggaatgagtatgtatggtgtaggcattcaatcaatgtttgttgaattgaatgcaatacaaatgataaaagtaacattacaagtgaattcttgaagtcttcattacatgtattggaaggtgtttttggcattttatccacatttctagttgcatccttagtgcctggcacacatgatagagtttcttgtactgctgtggtatgtatcactggctatagagtcaaaacccatgcttgcctctaattatttgattctaatgggggtttggggagtgaactcacattgaaacagtcattgatatgtgcttggtattcacaatacacatctcataaaatcttttaacaataatacaaggcagaattttcatcttcattaaattttgtaacagatgagaaaaaggaggctcgaatatattaacctgcctcaatcacatgccttgtaagtggtagaatggaaatgcagatccaagtttatcaaatttcacaaaccatgtaactatgttctttttttttttttttttgagacagattcacgcactgtcgcccaggctggagtgcagtggcgcaatctcggctcactgcaatctctgcctcccgggctcaagcaattctcctgcctcagcctcctgagtagctgagactacaggcacataccaccacgctcagctaatttttgtatttttagtagagacggtgtttcacaaagttggccaggatggtctcaatttcttggccttgtgatctacccgccttgggctcccagcgtgctgggattacaggtgtgagccactggcacctggcctatgttctttttttttttttttttttttttttttttaagagagactgtcttgccctgttgcctaggctgtagtacagtgacatgatcttatctcactgcagcctcaaactcctcggctccagtgatctccctgcttcaggctcctgagaagctagaactacagatgggtgccactatgcctggctattttaaaaaatttttttgaagagacagggtctcactatgttgcccagactggtcttgaactcctggtctcaagtgatcctcctaccttggcttcccaaagcactgggattacaggcatgagccactgtgcctagccaatataataatgttcttttctcccttttctgcacatctttgaaatcagatatcctagaaattattgttttgctatttttggaactggattgtcaatagcaaatatccttgtgtgttctgactatggtttcattctgagtttcatgaagctctaagcataaaacttcaaatcaccaagtagagcaaatggctcatggcatggtgttcctatcatgcttcagctttaagttgaggccactctttaattgattcagtctctatagagggtaaacaagtctcctttcaatagtccttgtttgaaatttcagttcttcatttgattctcttttcccacattgaaaaaccctaaggtccacatattcaaaacacgtctcatatttctcctcgtcctaaaaacctgggcaaccttctctaaatatgaccagagatggattcatgggctgtgttatcaccactcagtagttctggagtgacaacaaagtagtagatggccacataagttacagaattttcccagcgggctcataagctaaattatgccatcaagacataaatgtggaaggctattttatgataaaaagtaatgatacatacaacatgagcatgattcttctgcaaaaagggcatgcaaatttataatatatcgtttacttttcaagcatccatttggtccttctctttccattgatatggactccaaggtccatgggggctgggactttttggcgtgatgctcggttttgtgtaactaggtgcagcacctagttacagttcaagaacagaacaagggctcaggtagtatttgatgaataattgaatgagtataatataacatgatcttcctgacctgaggcacatgaaaagctactgccaaagccatctttctagcttgctgttgctgatgatctctaccctttttcactgctcttataccaagatctgggtttcagggctcaaattaggcccaccaggcttgcatttttgctcttgctctctcttgtgcctgttgttctcccgctcaccttggctcagctatcctcatgatggcctgactattcttccaaggtctaacttcaactacaactcaaaccattttccaccctccatgcaggcacatgtgttattctgaggaaccatcccaaaatgtttcctagtggtggagactcagggaggattatgtaaaagaaaacagacaccagattgggaaggatggtggaggtaacgcttcccaatagactctttttctgggcaagccatgttcatggcagatgcctaccacctgcttgttgtattctggattccctagtttgccagttcttttctaaaacaatgcaagaaatgaatgcaaaattatcactgtgctttgcccactgtggagcccagagcagtcactgctgcccatagccaagagattttgcttctcgtgatgtcacttaagattggaattaacgtcttcttagctgccatgctgcactgctagctatccagagcttggggcaatcatacatccagacccattttttaaactatatatgaaatgtaaaatcagcaccaactgcagttttccagaacacattctatacttgtatagagaatagttttacatttgtttttcaaaagtaattcacattcatcaaaacataatgaaaaaatacaaatataacaaagctacctataattaaatcatgcaaagatatctacccctaacattttcatgtatagcctcccaatctgtttcatgcatttatctctagctagcacctatatattttcacaacattagatcacattgtttatattgttttatgacctgccttttaaaattaacatatttgtaaaaaatacttctacatcaacacataaatttctacaaaacgcttttactggataagattttattttaaggatgcccaaagtatatgcaacctatcacataccgttaaacatctaattctttctaatctttaggttctaccaagtactggaacaaggaacatcactgggtctaagtatttgtgcccattctctgttacttccctgggatagtcaacattagcaattcaattaataaaaaatattttaagacttctgatccataaattttgacaagtattaaatttcatcctgtatacggcttaattacaaatgttaactctattttctgtgatatcagttatcgctacaaattcaataagcatttttttctatgtcttgtcattgatttttaaaagtgttcagcaagataaaatcactcattctataaatatttgccaaaagtcgacactacataaggcactctgctagatactggggtaaggggagtagaaattcaagagtgtataagccttaatcttggtcctcttttatttacttagtacaggaaacattgcttcattaataaataattctaagcattatttttattaaacttgttcccttgtttccattttttaatgtactaaaatataagttactttgtcaaattttaaaatacactgtcaaaatgaaaataagggtaatttggcatgaacatggcttactttatttccaccctggatttaaaaaaaaaatgacacatggttattttagtccattagaaaaattcagaaaagtataaagaagaaaataaatgactcataaccagaccattgaaaggcaattactgttaattggtgcatttccttccaggcattttctttgtatatttttcacacagctagatcatacaatatatgtaattttccaagcatataatgtaaatatttccctatgttatcaaaaaccctttgaaaacattatctctaatggctctataatattccatcatggaaatgaactacatatatagagtttgatcattaatagtaaaagctctggagtaagacttcctgggctgtcattctgatgctgtcatgggctggcttggggtcttgagcaagttacttttcgatggctcagttttcttatacgcaaaataggggtaattataatctctaacttacaaggtttttgtaagtgtattagtcccttctcacactgctgtaaagaactgccccagactgggtaattcataaaggaaagagttttaattgactcacagttctgcatggctgaggagggctcgggaaatttacaattgtggcagaaattgaagcaaatatgtccttattcacatggcagctggagaaagaaatgccgagcaaagggggaaaagctccttataaaaccatcagatctcacaagaattcactcgctatcatgagaacagcagcatgggggtaactgccgtatgattctattacctcccactgggcccctcccatgacgtgtggagattatgggaactacaattcaagatgagatttgggtggggacacggtcaaaccatgtcaataaagaataggtgagataattcaagtaaagcttaaactagcacctggtacataatgagtatgcaataacaattattattactactactcttactactactattactattattttctaaatcatttaacctattgctagatatttaagttgtttccaactaagatagcatttattattataaaatcactgaaggctgtgattgttcacaaacacttttataactttcaaatattttcttaggagagaatcagtcaaaagtatcaacactcttaaatactgcctaaattagttatctgtccttatgtacagtataatgcattgttgttattctaaacaggggaatggtatatccaaatcagaaccccctgtagggctttctcttgcctcatcctctccttacccatttccattctccctgcaacccctagatgacaagtgagaatcagaatctctggggcatttgaaactgacccttttaatttcttcatatgcaaaacgagaataccaatacctgtttcatggggtttttgtaataaaaaaataaaatgatccatgtgcatagcaatttacacatactcattgttagtcaattattacattattattaaaaaaattaaatttacaattcatacttctaccaggaatgtataagattatctatctcattgccctcagcagtgctgagcataattattttaaaatatattttaaattgtatttaaattaccaaaatatctattaaatttatttaaattatttaagtgattttaaatattttctaattcaataagtgaaaagtagtagtccagtattttaattttcttttatttgattactgttggaattgagatttttttcaaatatttattagccattgatatttggatatttgtgtgtgtgtgtgtgtttcagaaagagagagggagaaagagagatcaggatctatatttatttttacaggtgtctttgttttgtaattatttttctttttgagcatgggggaagaggttgctcattttgatagtaaagatactatccctagactgaccatgtcttattcctactgaactagttttgtctccctctggtcgatgtatatttctaaaggcttccgtgccatctgattaatgatctattttagagttttctccaagagcactgttaaacttataggcctgtggtccccgagctttatctttttttcatgttaaaaaaatctgaaaacgttagacagtctcttctctttagggcaacatgaaatctccataattactcagagcagatggggatggagatggtctgcagcaccttttcttggaacttgaacatggttgagggataatgaatataaacagcacagattgcacaattgccaagtcaatgaatcttggacacatggctagaaggaggctgagtcctgggcccagtgttggatctctgccctttcccgctgcttgttctccaagtcctctcattgggccgctaacttgtttttccatgcctcagttctcaccttgggaaactgatgtatgctttgctggctcgcagactgacagcttttgtaagcattacaagcaactccaagttcaggccatctactgttggcccctctgatgttgatcagtggtggtctgccaggatctacaggccacaggctcagcaggtccaatgtcccatggccacttttttccaagacagctcctccaacccctcctgtcgctgcctgcacagccctgaaaacctgccggatccccgtgggtgtgtctggattgcagatcttcccctcctgtctacaaagtgtatgtttccctcatagggatcacatgactcttccctgaagttttaaaactcagaactctcaatggctgggcccatattttgcccagcattttattttctataataataatataaatcacattgactgaacacttactctagctaggcattgtgctaagtgcttcataagcactctcttatggcatcttcaaggcaagcatgtaagattgcttctattattcccatgtcacagaacaggaaagtgaagtgtgaagaagttaaatagtttgcctgaggtcacgtaggtgctagtaagtgttggaactgtgagttgagttcaggccagcctgacatctaaacccatgatctcaactccaagacagcatggtaccatctgggattccccatctggcctccttttcccttaatctagtttgcagccccttttataaattccatatctcttgccacagatctctattaaacaaggacatttcaaagctataagaagacctggctgccatttcattcttctgggtgataccagcagatcctgatcctgctttacttcatgtatgacttccagggagaatggctaggttactcttgttcctagtgccccgctttcagggagagtgccccactagccaattgtgtatcttcctcttgggtgtcatgttttctatttgctcagagtggatttccttctacttatttcctagcctccttccaaccccctggaaggctgcttcatgttctagtgcttctctctgttggtcttatattcactccacttatatcaattcatgaaggtcagaaactcaaaagtctttatctttggggtctcccttagtctattcaggctgcttaaaaaaaaaaaaaacctatagactaggtagcttaaaaacaacagaagtttattgttcacagtcctagagattgggaagtgcaagatcaaggtgccagcagattgagtgtctggtgagggcctgtttcctgattcacgagcagtgccttcttgctgtgtcctcacatggtggaaggggtgagggttctcttttgggcctcttttctgtgggcactaatcccatttatgagagctctgccaaaagccctacctctcaaaggcctcacctcctaataccatcacactggggagtgggtttcgacatgtgaattttgggggaaccataaacatttagtccacagttctccctaacagtcaacaacccataaacacatcttcctcaagtctttttcaccccaagggtgagttaaacctagtatagatataattgctatttacctcaggcaggaaaacctcacagttctacaagtgtgggcagtgaggaagccatggctggaacttctggagtttgtgacaatagttcttggctccccctgcccatttcagagtctgggaccccagagtaggtggaaaagtcacttttgcatcttgttttatttctctctcatattctgactacagcagttgcttggtagtggcagatttaatagtcacactttctactatttgcaagcgaccccaaattacatgatatgtaataaattgtcattttgctgagataagaatttgaaaaatctcatgctatgaggctgggtttggttatgagtcacttagtgaatgatttattgttttctccctattgtagcaatgcattttatggaggtagtgatatgttacagcaatattcttgaagatgaggattccagaagtctctggatgcatgctgtacaaatgaccagggtttacccagtgtgcgaggcccagggcaaagggaggactctcctctcttcccctcccactgctgagtatgagaaattaatagggaattgacctcaccttcctacaacacctttacaggtcactgacagaacctcccaaggagtcaggggtgctcttggtccacaattataagagatagatgtagtattatccaattagcccatggttcattcacctgttccaaatatctttaatgcttagtcctgactgcttctcttgggccaaattgctattgtcctaatgaaaatatatatctttggtttacatttggagatattacaggatttgaggaaatattttcattttccatccagaggtttaatgttgtgtaagtgctgcctgagtgtgacctacctgtatctaataaaatcattaattcagcaggccggaaggtttagtttctgttatacctgttgccagcagctcatcctgtcccgatgctgcccagaatctccagtgacagcaagacccaggaagtcttgggaagacagagtgccacttgcagaaaaagagtccattatcttgaaagccgctcctggagtcattgccaaaagcagtttctccgagtttatgctcaaaccttggaaggcttctgccaccatgattgaaggggacatggaagaagccaagccatcttggccagcaaatgtcaccagtcatgatgagcccctaatcctgatgggacttctgataagacgcttgtatgatgacagatgaggctacacacagcagtttaactcagtcatttgtaatcattactttttggccattcaataaccatcctgtgaaattattttctgaatttcccagagtagagataggagccaagttttaccccttttctttagggaagcctcttgacagttacaaatgctttaaggaaactttctgaggcgctctcagatcaaccttcaaagcccttactcacccatgccacctgctttgtttgagtgatgacacagtgttggcgacaagcactgggaactttctgaggccaacgtctctattgtcatgtagacatgtccctggggcaagatgcagggtgacagtgcatcttgctcttctcattgtgtgattgtggccacatctcctgacccagagcttccttctccagtagtgagctgtggtcccatgtgtgctggccaacaggtgtgcagagacactgacctatggagcctgtcagcacactgggaggctaggccagaccaggagtggcagaagcccttgggccagttgcctttcactgcaagcaaccttaactctttactccagtggatcatataaatattattttctctgtgtgtcatgatatgaaaaaaggtgaggaagcactggcttagcctctctgattctttgttttcctcttgtgtaagttgggatttgtttttcttatcttattaaacctttatgaggatcaaaggcttaaatgaaagggctttgggagtccatgtatttgtggggtgtgtcattggccacagagatagaactctatccctctatctctagtttactttcattggctgttcctttgaaaatgaggtggaattccacttttttttagcctttccaagtcataaaatcaatgtactgtacctcctatttaggttcaagcacttacataacactataattctgtatagtctttgcttcttatgacttctacaaggtgcctaccagagcagaatctgcttatccctctgtctacttgtgctgagggtacacactagtgtatctgcctcctcctggtctatcctgcactcacatcccagcatctcccaaatccccgtaggcctgcccttcctaaggacagcctttgctttctcggagcttgtgccgcatttaatggcaggtccttgccaaggggcgaggggatcccgagttgccataatttcagcatctgtgtgccagggtgcaagctgcttgggtggtttaataggacgacttaccttctttgccctgcagacaaatctcatgggtgcagaggaactctctccttcccttctcctcgatatacttttcagccaagtgctgtcttgttaagtgagtgaaaaccaagtcacaaaccaatatgcaataaaatgttaacactggcttctctggatgctggaggtatgggtgatatttattttctcctttagatcttcttgattttttttcagattttctatagtaaaaccgaaagtgtattttaaattatattctgaaagatgcactcaagatgtgctgcatgaaggcaaataacagcttccacattccttcacacttgccagctccaaattactgcctctgcctttagagccaggcgatttggagggggtgggagctgggagggactggggaggaggctgcaatgtgggccattgaatttcctctttttagacatcgctctggcagctaattccagggtgctcgtctgtatggtggcagcgtgactttcatgttttccccaaggtgttttatggcctttttaccgtggtacttgaataactttctcccagtaacttccagatagtgaaaaaatgtcagatgatttctctttcccccaccacgtttcttcccttctttgttgcagctctattgcttaataggcgtctccttgccatctctcccttctccttcctctctcttcttttctctctctccctgctctcccctccctctttgcctctcttcacctcatttttaaagcaaaataaagagagaggctctgaccttgctggccctggccatgggagagggcaaggagagcaagccagggcttatccgtgacccagatggctgcaagaagagttcctggggcagattcaacccttcacttttccagaaggtaattcaggtttcagagcgaggggaggctgaggtttagtggctgggttccaggcctcttccctgcaggaaagttggccaacagactgagcatccgagaaaaggcaggagggtccctggcaagtcaggtcagtcctgttacggggcagagccattttaggtagcagttttagatggccttctaggttgatctggaggcatctgtcatccttaatcaggagaaggcagcaggcatttatgaactggtcactccttctgctgtgtttcattccctgtccttgttctcgattgcaatcaatgtcatctccaaggggttctttgctggacagtagcagtgtgattgggccatccatcaaggttcctctataatgcctcacttttcttggtggcaaataaggagctggcgctccgttctgagagacttgagttggaatagaccctgccttctccagcctcccaccctaccccactccctttaactagttaactctactcatctggttaagggcctcagtgcaagcatcagcttctcaggtaatcttcccctgcctctcgtaatgaagtcagatccctcatcatacgttctcatagggttgtgtctgtctccttcacaatggataacaacatcaagatgtcaaaaggacttgagaggttgttggatggctgtctgctgccttccacactctaagctcctcagcctggaagctctaagagggtagtgtggggttctgctcacgaatgcagcccaactgccaagggcagagctcggcacataggagatactcaggaagtatgaatggaattaatgaattaatcttagctccaccccttttggctccagaaccttggacaagttactcaacctctctgagcctcagttcctgcgtttgaaaatggtaataataatccccactcagaaaattgtgggatttgtggggcaatgactataaagcccccagtatggtgctgggcaccgtgtgtaataggcacacatgaagtattggtttctttctcagtgattttttttttaaaaacatcccagagtattgcagcttaaaggtttaaagaacaaaaacatgtctccctatttcttctccctcctcctttctttgctaccttctcctgtggtgggtgaggcatagaatgggggcacagaagatcatattttgtgatttttttcactaacgagatgacttcgagtgaagcatctttccttcctgtgtttcagcttgctcacatgtgtgataggaagacacagataaatagtcttcatggcccctcccagctcccccactctgagtctctgcatgaggccaagggtaacattgatcaccattgttaacaatgcaagatgaatggaagcaacaaaggtgacatagcaccagagtaggatgaagccaatcaggctgttggcctatctattttaatacaagctgagtttattttagtaatacaggtgaagagtgatttaaaatatagcatcatgccaataccccttagtaaaagcacaaggatttctagtgtacctttcttcaaaagagcctgagggctttgtagatactgtctcattaattctttgagcatcccaaaagttggctgggaaagcatgatgagttctgttttacatgcagagaaacaaagcttgaaaaaggttaagcagcttacccaaggtcacgcagtaacactgctgtatctgagaacacagttctctagcacatcagcctatctctggaaatgagttcagtcatggtgaggggcctttgtgctgagtaatgtggcatctggagctggggcttcttagaggatagactctttatcctgaaatgacaggggtgacaagtagataaagagggattgaaaggtctggaagttaggagaaagtgttttgtccctcttcttcccctcaccctaagcatcttcccttggacaagccaaggaccaatttcaaggatccaggcatcaggctttgtggtggttgccatggaaacagtcgtggctgagcctgagaccccacagagccagctgccctgatggaaggtgtgtgtttctaggtcgacttcctggttgacccaaagggatctattgtcctcagttaggagaatgcagcaagcatctctgacctggtcagtttctttcttctgtatttaattcccaacccctgttccccaggagaatcatcacctgcaagggatttgtactgtagagtggcattcctagctggtccacacatcagaggtctgcagtcatacatcctatcctagtactcactggcaatgtgaccttgggcatttgtgctttccgagcctcaatcttttcatctgtaaaagaggttaactaccaaagttgttgtaaggatcacaaaagcagatgcctctgaaaggcatcagggagccctaagtcatggtgaatgtgcacacagttgcaatccactcttccacgctggagctcccttcttcctgtgaaagtgggtcacactctccccagggcactcactgcatgatttcaggagtcatcctggtaaccgttacttcccaacttgaaacatcaggtcaagagaagagccagttgttcttggatagtttgtagcctcttgtctaacatgtctggagactcctgggcctgctggtgggtgattatccttaccaggactctctcactccaaaagaaaaaggtcttttgttgatggacttggttttccaggctgccctgtctttgtgtctttgtgtctttgtatcgctttcagtatattaattatttagtgcttggtaaagctctctgagatcacaagatgaaaggcctgatggcagttcaaagccttccttttgattattattctagtcaacatattttggggggagaaaataggcttaagatcacagtggagtaaatttcataaagagcagagtacaagcaaaccacagaaatggacccaaacagagagtcatgttgccctgctaatggaagcactcaggtcttacgggggtagggagtgcgggtgtgttaagaatcaggccacctggagagtgatatttgctgtcttggattagtaaaataaaaatgcccattagtcttccacagctaccaaaagccagtgtgagtccaccttggccagttaggtagggccagtgaccaagcacacctgcagcaggggttcagggccaaaggagacattgtgacgctcatggatgagtcaggaggtgcttgcttgggatgctgaaatcatgtctggaaaggtgaaaatgcagtgagtgacctggaactatcaaattctgagagatacaggttctgaagaggaggcatcagctgtcacatggccttcgttataggactttggccatgaattatgagtcactagtacctgcatagatgtggtagctcaactgatgaaataggtccatgtcttgatctgcccctgcccctgcaaagcatgtcctacatgacaccaaaccaaaaacagccactgtgaaatgcttttcctaattttttctaaatcaatgagcaaaaaaaaaaagaaaagaaatcaacataaacaacagacctgaaacttaagttgtgtgagtgaaattaatatgcaattacaatccatcgtcattaacatgtttgttgaatggcctcaacaccactatcctaagtggttaaggaggtcagggcccaagttcaggttttgttctggcacaacccgaatcccagctcaactgctttggtgtccagctcagggaagacagggaccttgaggaggagggatttgagctgggcctttaagaaggggtaggatttaggaaagcagggggtggagaaggatgttctaggcagagattagcttgggcataagtttggagactaaggagtaatgggatagaatgtgaaaggaaggattctgaatgggaaataaggctgaaaaggcaaacagtggccagagtgtttgggctccagatttacacgctttagccattctggagcaacctctttgtgattcctttttttttttttttttttggtataggatagcctgaaggtaaccaaatccctaagggtaggcaccatgctaacaatttcctttattaatattcctcactgttgtgccttgggaaggggtacatgctttcattggctggcagaggtccttcaccattgagtgaacacaaaagttatacatgggtcctcttggggaggcaggaaatgcatgctgaagctataacttttgacagtacaaaagaatattatgggagagtaatttttgcttcaatatttgagctactaagaaagagcacaaacttctctggcaggatgggatggggcttagagaaaggtgaggtggagtgggagctgtttaattccatccaaattccgcccttgacactaatagctcccttctgaatgagccagctggaagaaaatgtgaaagcaaaccatagagaaacaaatatgtatgaaccagagaggaccttagcgagcagtgagttcaaaccgctcattttccaggcctagagaaggtatggggagggctatatgtttaggacaaatggtgcatctgcaaactctctcctttctctgaaatcacatctctgtttttcagactaaattaacaacatcgcccatcaccgctaactctaggagtcatgtaaatttactgaggtttcttttgctgaacaggtgcaggctcagcctagtgaatacccaaaccatttcccctgggctgccagtcccaaaaacaggcctgccctgtactctctgagagctgtgcctgatttgacatccagaccactatttatttggccacattaagctttgctttgtgtgacacaaaatcattgtaaacgaatgcattattaagtgtgttttcaaataacagggaaaaaacaagcagactgtcactgattgttttattgttggaaggaaaagaaataagtaaaacgtgtacaggcaaggtaggaactgttccaaagagcatttagaataggagcatttgttacattttattgatgtaggtttgtaaaacatgcttgccagtgagcctggggcattcatgtaaataaccatcacacatgcatagctcttcattacttatactgacacaagtatgatatatttattatattatgttcattggcttaggaataaatagacatgcagtgagacatgtaaaaataaagattggaaatacacagtgccaatcggctgcaatttgggtagttgtgatcatgtacatttggcaaagttaatgattaactagtgaataatagcgaagcagctctctgggagcacttttgatttctggacgttgtaattattgacacaagatgatctaaatatagaaaagagaccaagactcccactcattttggattctaaaacagagataggagcatacaattttaagaatgatatgactgatactgaaagactgtgtcatgcacacattatctcatgtggcccttacaaaaccctgagaatttttagaatatgccctattcttattctcgtcatcgttttcagaaaattgaggtttggcagagtgtgtgcttagcctgaagttaacagctaataagtgccagagataacaccttcctccagggcgctgatttcatttatttgacaaatatttattgagtgcctgctgtgtgccaggcatggagacatagcagtgactagtgcaggaggtacacaatgaataaaccaatatacagaacacatatatgtgtaagaaatagggcaaagggatgggagtggcttacaatgagttgtctctcagcaggatgaccagggaaattctttctgggaagttgacctatggacagggacctggacagagagagggagtggccatgtacctctgagtaggaggagcttcctcggctgagagaactgccagtgcaaaggccctggggtgggaatgtgcttggtgagttcggggaagagcaaggagacctgtgggactgagctccagcaatgagggaaaatggttgcaaatgaggttagagacagaatcaggagccagatcctgtggggcctttaggggctaggctatggcaagaaatttgaaagctatttcaggggctgcagtgtcaatctaactgccacatagagaacagactgaaggggggccctctttgagctcatagcaataatggagagatgcgagatgggaaaagatgagaaggggtaaaattcaggtagagccatcaagatttgctgatgaattgatgtggggtgtgaataaaaggaagaagttaaggattcctcattggtttttggcccaagcaaccaggcgagtattggtaacactttctgaaatggggaatacctggggtttaggggaagggaggttaggtttttggcttgctcatggtaagtttcagatgcttattgggcaataaagtggagattttgagcaggcagttggatgtatattctgtgtattctgttgttcaggggagagattgggctgaagacacaaatttggtaacagtagtatgtggatgatatttagagccatgaaactgggtaagatcactttgagagagagtttagatgcagaaaattcccaagttcttcaacttttaacaactgtcaaataataaaataaagatcccacagagttgttttttatgacaagcttacttacatgtcgggcaaggagaaattcactgtatggttttccaagtaagaaaagtcagagtttttaaagtcttacgaagagggctacaatgtggttctggttatttggagttgaaaatcggttctttgaactaaagagaatgaatgaatgcataggtttgtgtgagcatgggtaaacaagttatcttcattggtcagcaaagagtcttcagttaggtacaggaagggtctggtgtcccgcactcacttgaaatttattgatcatcagctggttagaaccagtgggataaaatataatactcagccatgacagttcctaagcaagtgctgccggaaaaggagacgtttcctcctctacagtttggaaaataaggaagacctggcaaagaagaataaagaggatcttcccactgaagcaggaggcaaccaaagactatgtggtgaccaggatgtgaaaaatccaagaagcagggagtgattgcaggggcaaatgctgctgagtggtccagtgaaacaaagacctagagttgttcaatgtatctgcagcctagggtcgtcggcgaccttgaggtggagtagtgaagacaatctagattttgttggatttaagagaacacgggaagaagaaggtggagacaggagcaaagacaaatcttttaatagatttagctgtaaagaagagcagagtaaagggacaatggctggagaagagtgtggcagtcaaagaagctttttctttctttataagatggtgcatgtttgtgtgactgacttggtagagagggaaaattgttgatgcaggaccattgtaacagcagatcccttgagaagagacgagactagcacctaagtgaagaggctggcactgtttaagagagtaaactgttatcctttacaacagaagagaaggcactgatacatgtaagtgggtagatcacttctcttttctcaataagctaagaaacaaattcattcactgagaatgtggaagcatatggggaattggagttttgagaacttgagaggaagtttgaactagttgtattggaaagagagagagtgaactgagttagtcagggaaggcaatgggattcccgggccatcctgagggtcttgaggtttctggtgatgaatttaaaatgaggcctgtcagcactgttgtgtgttcctccacccctcttctcccactaccacatctacctgctccaggataattgtaaagaaagaggcaaaggagttgagattgtgtgaaatgaaattatgatagagatgagccctggagctgaagctgaggacattagggggatgatacacagtgaaaaattcagagtgtcaagagcttgaggttttcactctgccttgataccctgcagtgcctagaaagggcttaagaaatcatcagaaaaacagcaacaattgtattgctagcaaatcaataatgccttcagtccaggtatatttcttcctcctttctcttcaggccttcacttgtctgcctcacttgggcacctagaagctcctgctcctatttccccactcctttctcatctacgtttcatctcccaaggtccaagagtcactctacttgagccagttggtctgcattcataccttcacccatatatctgcattgatgaggcccatttcactctggatcctcatattttcagagtggaaccctgaaaagacaaggctttctctagcttaaatggattgcttctgatggcatggcttctctttctgctagaaaatccttccctgcagtggttgggtagggcaagggtaaagagcttgatgggaacagacagtgtcttgaccctgtacttgttaaatgcagaagtattttgttctttatattctacattgatgtgtattctgtgaactttgactagcactcatttctgttccaatgcttccgattttggaaaacaactgcattcatgtgggctttgctttccttgatccttgacttttcaggtggggaggctcagccttttggctgacccccacattagctccctagcctcatccggcttatcacttgcactccctactctcaggggtaagattggagaccctgtgagcccactggctggaagaaattctaggagttcctgtaagggcaagttaagactttctgctttttttcaaccctgcaatattcaaccctgtggatgcctggcaagttattggtgttttgtgatataaaaggctttaagctcatgcttctgaagagatggcccacagtgatgtccatattaccttgctgggtcatgacccagccctcagagcccttccttttgaaagctttctttttttttaaacccctgaatatattatctggcccccattcatattaaagttatctgccattctgtacccattcacagattcataagtgctccctgaagtctagccccatctgcttggttcctcacatccaggaagaagttaatatcattcccaaactgaatggttcagaaaaatgacatcacttagaaacaggaaagtataacctaggcttagtcttcctgtcacttcaaagctacttaaaatttgagattagccaatgactcagacctagagtctaagtgaatttttattcacatggagattgattgtccgagtcttcccagacccttcccacttgccctattctgaagcatgctcagtggtggcctctgacctcagccattgtgtcgtgggggccctgccaggccctgtggagagctgaggaccaccctgcaccagtctgtggcctgtgcagagtggtgaaaggagcttggacttcagtgtcagttgatctagtcttttgaccctgatttcctgtctcctgctggctgtgtggctgtagtcaaggtaactaacgtctttatgcctcaatttcctcagctgcaaaatgaggacaaataaacttattcacaaggttactgtaagaagtaaacaaaatcacacatttaaagcacttagcatcataccggtccatatgtgctcgatacatactaattttttaaaaggctaataaacttaaccccacccaaagtaaccctacgtggctttgcattcacttctctgagccccattgcctatctacgaaacagagttgatgtgcaggtgaaatgagatggcttctctctgcaactcacaaacacagactctcacccctttcagtgcatttcctctgagctgttttgcagaaatgctgcagaaagatgtacctggcacaaatcaattcagttctaatctctgtagaccaaatataagagaaaagtcaaaattctttcctagatacccaagagccagcacttccaactcagagctatggaaagcagagattaaaatgtttttttaggaaggagaccgtggaatgcccatcctgtcccagttgcagggcacaagggcctttaataagcattgcctaagggcagcacctgcaggtaaaatagtggaggggtctggaaacaagagactgccatgggtacccaggccagagatttccttcaagtgtgtgaagtggggtttatcctaaaagggggttagaggtaggagaccagaacctgcaagagctggtacagggggtaatgtggaagaaactgcagagcaggcagactgggaaaatgcctctgctactcctgctgcctgccttttcttctttctcttcttctcctcttctcccccttttcctcttcacaaagtccctccaagtgggttaacagttaccaccagaatagcaggtcagcccattcaccatagaacatggcctgctgatatgaggcaaacctgggctcagtttctgcttccatcacttgcctctctaggtctcagttgatgcatctgtaaaacagagatgatcatttctatctcaaagagccacggtgaatatcatgtgacattatgtaggtaaagagtccagcatggcgtctgttccggggaagctacagaagaaatgctaatttccttccttccctcctccctgcactcagtcttgtgacacatctatctatgaaagagaactaattctcaaatccttccttctttaacaaaaaaggctttgtctgccgtaaaacattagcaaatagtgattgagcttgggattttctgggaagcactgtgttagatcaggcagtgcatgatcatttgatttgtagatatattgtaatgacttttcaccacacaaaatccacatgaggtgctgctaaggacaggaataatgcttctctgctgcttttctttcaagccttctttctctcatgcaaatcagaaacattaatccttttggctttctggcctcttggctttgggaaaactccggtcacctagcttcccccacaaccctgacaataacataattgttaagaactcataacttcagagtgcagtttcagccctctcattgataaggcaataacccaagcaaacaacattagaggaagttacaagtctgaacataaagtagggatggaggcattatctggacgagatgaattggagttctctataaagctgcacaaattattataggcagaatagactttggatagaactcttagaccaagccattaagtgccctggcttctagttcatctcccagagatcctcagcatggccttggtcagaacattcagacctcttagatctgtctgcccttgatagaaaatgtacatcagggtcctgaggtcaactcagtctactggtggctcaattttttccccctcatcttcccgatggatgtcatgaaagccccttataaacttcatttttgactgatattgagtgacagctaaaagacacaccccaagcacatggatcagtgttttctttatttttatgtccaggtcatagctccttggaatcaccaacaaacatgccttctccttctcctgattattttacatggaatctcacctggataatgaaagactccttccctttcctgtctcatcgcagccgatatggtaagtatatgtttaatatttacttgagatacactgtcactatctcataataaggactctgtgagtttcagtttgggattcatagtgctccagggcattccctcagctccctatatgcaaaagaagtctttctgagccctctgtctcccagtgacgctcaaccccgtggaccattccagccaggccattccagctgcattctgtatcctggtgggagccaagggctttgtgtctgccatatccctcctgcttagcctttatggtatatagtgttccagccatccccttatcaatcattagaggagatgcttatttgcttcttgactgtagcttgctttctggttctaacccacagtgtttctagcaatcacaatctctctctctctctttttttttttttttttttgagacagagtcttgctctgtcgcccaggctggagtgcagtggcacgatctcggcccactgcaagctccgcctcctgggttcacaccattctcctgcctcagcctcccgagtagctgggactacaggctcccactaccatgcctggctaattttttttttttttttttttttttttggatttttggtagacacggggtttgactgtgttactgtgttagccaggatggtcttgatctcctgacctcgtgatccgcctgcctcagccttctaaagtgctgggattacaggagtgagccaccgtgcccagccaacaatcagtctcttaagaggggattattattatgagcgtcacaggtcttccagggccccttacagttaagaagctccttaaagtttcccaaacatgttctttgatattattttggttcatttgattctgcaacagcatccgacatgaagagaccaggtccaattacatttttacagatgtggaaactaggtttaataagatcacacagagtggcttctccagctaccaagccagacttcttcccctactttcattttttctcccaggtaccacctacccacccgggtaggtcctgtcctagcagccctcaggaggctgcctttacatggtataagattcctccttctctgtgctcattctaacagctcatagtagctgggtctctgcaatgagaagatttagaggagagaagaagcatttcaaatgaacattttaattctcttgaactcctctagggtgaacaccataaggacagacactaagctttgctttccactttattctatcgcatggaagatatgcataaagccttattagtctttcaatggctactttcaatggcaataaccacagttacttttgcaccagcctcatatttatgatgaatgaatgcaaaagtcctccagaatgaaactcattcatcaggcctgattcaattaagtatttataaacctggtgtggcacggagttctagattcccttctgggcatatttacctattcctctatgcagtctatacccttgggcctaagctatttaaaatgcacctaacagagatgttccactcactatagaaaagcttccagtccaaagcctgctgtctctcatctataacgctcttggttcatattaactgtacctttctgtaccatattttaaacttaaaaaaaaatccatcaaaaaccctggggcagtttataattatcttctgtgctggaatgtttcctgtgattcttaagcagcccttgcaggagagaaagatcagtggtcgtcaggagattccagataagaattacttcctgattttatttaaaccagacactgagtgtcatcttatgataagggcaagtatctataaataattgaaatctggatcttttcattgttaatgctttgtaaccagatttgcgatacaactggtcttcaggtaacatttttgattttgctcccaaagtcattcagtatctctacagaaggacaatttttataaaatgcagaatgccccaaggggtaaatctacccactccatgctgcagagggcaacatatttgttccctgtggagcatcttataagaggttgcaggtcaaaaggagaaaatcatgaaagcttattaagctgcctcctacccatggcttggccctgataaaccatgtggtgctccctgagcttcatcctccttatctgtaaaatgagggtgaaatggcatgccaccttagggcaaaggaatcgatctggaggtttttcaagatctctttcaaactctcctcctggtctggaatcctcatgatttcccttcttggcagagtagaggacccaaaccattggcagttactgcccaagttctgggtaagagtacccaagtcatcaccatcgttgctattgatttatggggaaggaggagctgattcttcattggtggttccttaactgactatggtgggcattccagaggctttacatctttctgccatatttaattcagctgagacttatgaagacattaccaccaccatcaccatctctgggtgcttggccctgtgcctgatgtgggaagtgatgcaaacataaagacaggtaagggttggcccttccctttcactgctcataggacagacaaatcattccataggcagctaagcccactgccatagtgtccccggtgggctgacctcagagtacagatgttgaggacttgccccaagacccactgcagaacaagctaaagacagagctaaggccaagagtctggtccccttaaggatgttggtgggagctcagcccacatgtctatgaatcaaagaggccagctgagttgggtgataaatccatacctttcaactgccgtgaaagacattttaagaaatgttaacaacttcattaattttaaggcctcaaacttgggcagataaatttgactggaaaattgctgcctgaagggatcgttcttcagacagtgagaagtcaccaagtctctgcaagtccatcatggaagtccacgcttggttggctgtcttcacctgcatcctggtgggaggtcgtcagggtgggggagtgagagtgagcatcaacaacctgaccgcaggtgtcctgatgaccactaggctaggcctctgttgggtgagctgtccagttctgaattggaatggctttcttttttccagtgttttatgagaagagacaaggtggaaagaggctaataagatttattcacccccagtctgtaattatctgcttgaggaaaaagtttgacctacctttttgaaggctccccatatttcttctaatttgcattggggcctaatatgctgtgtaaaatatattctcttccgtggcttttgacatcagattccagtcgtttctcgcctttgtgttgaatgacgagcgcccactaatttcatcatcagcgagcagagggctgcacattcctcccctaaggctttgagagggaggacgtctaaagaaagactttatttttctttttatcatcagctctcatgcccttagacttatttataggcttggctaaaggattaggctctaactacctactcagataaaaatctgttccatcaggtagcaccagatgctaaaagattgaggccaccgggggttttgaaaggcagttttgatcaccttgagttttagagccacagagacagatggtatcctttccacctttaaatcatatttgcccactctgggtatgggaagaatcacatcaactttttaaacaggacgatgaaaggttctgcccatatgagcaggagaaagggacttttcatttatttaaaaaaaaaaaacatgatacattgcaaaactctttttcacccacttttctcatttaagttgtattataaaattgcagtagatgaaaattattttatattttatttttatggaaatacaaatcgagggtcaaaggagtttattaatgtgctttcattttacggagtaggtgagccattagaaaagaatgaacctggactttctgactctctgtgtgctctttctatcatatcacaaagttatttcaaagatgagctttccctgcctggagagcatgcccacttcctggatgacctggtgtttagctaaatgatcagtctgatgtctaagaccttgggtagctatgggaccaagacttgatatcaccaaatggagactatcccaggcaggccaagtaattcaaccctttctaaccatgagtggaatccccttggcactgtaggtagtcttgtcttctctaccctccctccccatcccagactatggtccctggggattgacttgtgtctccccacaaaattttgttaaagttctaatgccctagtacctgtgaatgtgaccttatttggaaatagagtctttgcaatcaaataaaaatgagaccatactggattaggatgggccttaatccaatatgattggtgtccttataagaagagaaaacacaggcacatatagggtgcacaccatgtaactatggaatcagaaattagagtgatgtgtctacaagccaaggaacaccaaggattgcgggcagcattgggagctaagaggaaggcctggaacaaatccttctttagtgcttcagagagagcatggccctgcctacatattaactttgaatttttggcctccaaaactgtgagaaaataaatttccgttattttaagccacccagttgatggtactttgttatgactgccctaagaagctgatccagccccctaatgtccaaaacattggctcctggaaaagaaaatattcttcccaacatcccaacatctaagcacaacaaaataattgttagatttgaataaaagttttattcaaactttgtctgctttccagtccaaggagacctatccagttcaggggctggtgcttttagaaagaaaaattagactttttaattactttccctgccactgccaccatcaccacccatcctgttaatgtatcaatttctttgattgaaaagactaggtaaattaaatatctctctctcaaaaaaaaaaaatcagcctaacacagaatcaaaaatggaaaacacaaaggacctctggctctgtataggatttgcttcatagctctggcaggaagtcagtttgatcgcatttctgaaattacgtatttaatgtggctggctgtgatcagccattctggtcctcaggagcactggtgtcagtgaaaagcagctcccttgtggactgttgtcagggctgaaagcttccttaccaactcctctgccccttccaggccaggtctttttgtgttctcttcctagccttgctccactgagctagggggtcaagctctttcctagctcatgcctctgtattttcatctacaagcttgataagcaaaagatctctgcatgcattcaccacaaagtctgagtcccaaaggggacagtaatgctggcagtcacacaagaccaaggatcagggaccacctatcacctggagggccctgacctgctgggagccaatatactcaatccatggaaattcaatataaaggagttgccttaggtgtttcgaggagagacatgtttaaaatgctcctcttggtcatatctctttaaaacaaagacacatagagccattcataaatatgaacaatttatctctatgttggtggcaagttgagtaaggaaatgcagaaagaaaaaacgtcagaataaaatataataagagaatgaatgaccatgtgacacaaaggtgagaaaaacaagtcagaaaagatccattcaaaacacttttcacaaagtgggacagacactgacaaagggaaacagatgatgaggggaaggggacagagacagagagagacacacagggaaagagagagaaagacacaaaagtaggggtcgcccttggctctctgactgccttttcatttattctttttcccgttgacatggttcagctctcacccctgggcaggtggctccttagtgcttgcttcagtcttgacttcccccttcagaggccctcccacaacccccaccctgcctgcatcatttcccccttagcacgtctccaccaacacagagaatgggagaagggatgtcaacagtcgtggagtgccgagtgtatgcttagttgtgctctagacatgtcagtgataaagacaaataggacacatttgcttccctcaaggagctctgggggaagaggtaagcatacctgctctttgacaaatgcagtaacagaggcccaggaacacagaggagggaggaccaggtctgtagaggactcaagaagggagatgttttggagactgcggcagctgaactggaccttggactctagggaacacagagagtcaggagaagagtgttctggacaaaagggatgcatgtgcaaaggtgtttgggaacaggtcaagctctgtggcaaaggttgtagaggacctggggtgaggctggagagacagttactctgagaatgctcaggagttgggcatggtcctacatatgaggcataggatggaaaagaaagggaaggaggagaatctggaagagattctggatataaggtgagcaccacttggtttcctattcaggagaatccaccttgagtaattgagtggatgaagatgtcattgactggaacagagaagagaaacatttggcaaggaaagatgttgaccaagacatctagagggaggaggaaatgtggtgagatccaccgtaatcaagttacatttgaaatgccttcaagacagccaggtgaagatggccagtagagagctgtaaacccaggtcttggctttgaggagagaagtggatggagagttattagcagcaagactgaggttgaggccaggcacagttgctcacgcctgtaatcccagcaatttggaaggccaagcaggtggatcacctgaggtcaggagctcaagaccagcctggctaacatggtgaaaccctgtctctactaaaaatacaaaaattagctgggtgcacatgtgcctgtagccttagctacttggaagtctgaggtaggagaatcgtttgaacctgggaggcagaggttgcagtgaggcgagagtgtgactctgtattccagcctgggtgacagaacgagactccatcatacacacacacacacacacacacacacacacacacgcacacagactgaggttgaagctggtgattggaggttgaagacccagaggagatccaggatgtttcatttgagaggtaagcagaggaagaggagcatgaaacagagagatgaagaaatgggagacaggaggagaaccaggagatggtatagtcacctgtgttagtctgtgctcatgctgctaataaagacaaacctgagactgggtaatttataaaggaaagaggttcaattgactcacagttccacatggcttgagagacctcacaatcgtggcagaaggcaaggaggagcattttgtggtaagtaagatgtgcttacctcttgccacatcttacatggtggcaggcaaagagagcatgtgcaggggaactccacattataaaactatcagatctcatgagactattcactatcatgagaacaacatgcggaagacctgcccccatgattcaattaccttgcacagggtccctcccatggtacgtgggaattatgagagctacagttcaagatgagatttgggtgggggcacagacaaatcatatcaacagcaaagccaaggaagtgaggaatttttagatgaaggaatgttgtatgcatgtgtgatacccccaacattccaatcagttctgtggagacagaatctctctctgggtctaatgaaccatcagtacctaataggaaggtttgctcatttttagcagacatgacatggctcttggatttaatagagcttccttttggataccatatagcaagtattcacaaccagcagctggtgaccgcactataaccccaaattagaacagtctgggaggtggtggacctcactttatccccatattctcatggagaaaatttttatgtgtctccccgctacttggtgcctctgatgtcacacttttccttgtgtcttagttatttgtggtcctgcgttatcactcttcctagacgttaagcatttaaacgtcaaggaattcacatcttgtttccttttgcacacctagtacttctctcatgttgtgtactcattgtgtactcaatagaagtaatggcaatgtctgctcagcagttcagggacaaatgaggagcaaactgaggtctcccaattcccaacctacagcctttcagcccccaaagttctctgttttattaaagggcagggacattcccaccagccctctcatttctagtcatattaatcagtttcaggaaagaaatgtgtctgagggggagaccagttcctgagctggacttaatttggttgaggattcaaagatgtgattttaactactttgagcaggcttgctttttttcttttcttaacataaaaaagcatattcagcagacatgagtgagctgaggaatttctcttttgacagctttgggacatctgagatactgtatacagagcacttctaaccaacctagaaagacgtgtgtccaaaacatgttcaggaaaaggactgatcaagagtgagaaaaatgagagaaaatcctcttaaaatgttttgtcgagagcaacctcaggtgcaaaactttgtgtcagaagagacctccaattcacaggacttgaaccagcccatttgggtagatgactagaataatttggtctatgagaagttcatagaaattgtgagctgtcagggccttctgtggtctgatcaaatagccacatctgtaggatgaggaaacaggcctagagaggttagtgatctccccaggactagcagcaaagcagagattcaaacccaggccatctgcttggcagagcccacacctaacctctctaccatagaggcaagggttcattttcttctcaataagatggctcacaaagtattttctcacatttcagtcccatctgttgctttacacaactcatcccttgaataccttgggtttccagcccagcagagttttgctgccccacagattgcctcagtgtggggtcagggccttcctggtgtagatgaacacatggccacactcagtctagttgcctcatagtcacttggagagcaccttaaaaacaggattctggtgagggtattcactggactagagaactaggtctggtaatcctagggctttaactcacctctgcattgcctgtttaaatcttctctgggccaggcacggtgattaatgcctgtaatcccagcactttgggaggccagggtgggtggattacctgagatcaggagttccagaccagcctggccaagatggtgaaaccccatctctattaaaactacaaaaaattagccgggcatggtggcaggcacctgtaatcccagctacttgggaggctgaggcaggataattgcttgaacccaggagatggaggttgccgtgagctgagactgcaccattgcactccagcctgggtgacagagcgaaactctatctcaaaaattaaatcaatcagtcagtcaatctcctctgtaacatcccaacaaaaggtcttccagcctctgcctgaaagcaacacatggaaccacagtggggaaaactcatcttgggaatctgagatgtggaatgaattcccagctctgattcttgtgagttgtattaccttcagccactacctactccttttggttgtctatgtcatctttaaagtggaggtgatcaggattaccaactgacagcattattatgaggacatgacgacagatctgaatgtgcccagggcacagcaaaaggtgggttttggtggcatggctccatttgctctaagcctcttgcttaaaactcttttaagtccctagttttgccctctggaacttgaaagcattttgcctttaatcacactagtatttgagctgggatttaattcatgcagttcagcttcaaaatttatacaactatactgaattaagcaatatcagttcttcacctgcctagaataaccttatctcctcctctgttcttagcaaacttcctagccaaacccttactatctgttcaaattgtttcatccttcaagatgcagcccagcagttgctttttctgtggacctttggtcctcccaggcaaagagcctcccttgttctgttttccctgaggcctcttagagttaggtatgggcaagttcatcccccaactggactgggacccttccctgaagggtagaaggtctgtgctcgggcagtctggtaccttcctgtgtttgaaaacagggaggaatggaaccccatgttcacattaacacccagtaggtcctgtctctttagagacagaagagtaagtggggaggtccgtctgcatattctggggtctcccttaaccaccaggcttctcctgttgtcatggatgccacattgctcagagttcatctccagccttctggtttcaggaataaacccatttagacagatgtcatattgagcagtgatacaactgctaaggatttcaccatgccctctggagcctgcttcattctgttagagacttccttacccaacacacacacacacacacacacacacacacacacacacacacacacacacacacattctgcatgagtgtttcctggaaattgcaagcagagaattaaactggaagtccaatctgggttctggtctcaactctcttactgctccaagccctaggccatgccaccttggccaagtcccttcactcttctgagccttaattttcccatctataaaatgaagaagctgagctagttaacctcagaattaattattttcaattttctgttctatgattaagagcagagtcctgtttttctatctgtaacatagtaatggtcacagataagagaaataagaattcagctttccgtgtgtatctcccactgcagtgtgcacatgtgcacgtgcgcacacacactgccctctgaggctgtgttcatgtaattgattgatggaaggagacttggcccttcttctcttcagcttgattataagtgagctaaacagatgtcttgaattgggtgattggttcccagatgcattccagggagcaggctggtgggaaggaagtgaatggtttcaagttctggggctctatgacaaatgaacagtggttgtgggcagagggggtaggggccaggttggatacttagtgttatgaagcaagtgaccagatgttgatggcagctggtggattaataacaaaggtgactggtgagccaaggagataatccagaaagggggagccacagtccctaatcatcggagcctgggctggaagtcaggccccctgggttcctgctgaccagctggctagagtgaagttagagagtttattttggccacctgcccaaaggggcaattattcttagcatggtagagatggaagagacctgagaatcattttattcccccactccattttacagatgaggacactgaggtctggaaagcttaagtgacttgtgtgaagttatatcacagagccagagctagaacccagatcatctcgctggaggtcttccaaaggcaagctcaatcagccatcgcaaaggaaatattgagagaggagcacacgtttctccaccccttttccttttatgcttccagctgaaacagggcttgaaacaaagttttcttcctgctgtgctggatatactccctcttatgtgctctctgccattgctgactcctggagacacttaaagagtaacagcaatgacgcgcatcattaaataaggccaaattgtgtgcaagtcaccatgcagggcactcaacatacactattgcatttcaccctcctcacaattccaggaggtggtccctgctttaattcttatttttcagttgaaaaaattgaggcacaaagggattaattttctctgacatgtggagctagtaatggcacagccaaatttccaacttgggagcctgacctcatgcaggatctgtgcttgcagttactccctgcaatgcctccccagacactctggtgcctctcccagccccctgagaggttgatataaaatagggcaaggaaagaaggatgtctgttctagcctgcttctccctgggtcctccaaggtcaagtcaggtcagttcatccccaggttcctggtggtaaatctgaggcagaggaagacacagtgctgtgtctgcatcacagggccaaggtggtaagagtatccatctattaatatatggtatctcagggttttgaaagcatggcgacattcattaccttatgcaatcatcacagcagatatatatttatatatatatatatatatatatatatatatatatatatatttcttttcttttctttttttgttgagatggagtctcactctgtcacccaggctggagtgtagtggcacaatctcggctcactgcaacctctgcctcccgagttcaagcgattctcctgcctcagcctcccgagcagctgggattacaggcaccagccaccacgcttggctaatttttgtatttttagtagagacggggtttcactatgttggctaggctggtctcgaactcctgacctcaagtgatccatccgccttggcctcccaaagtgctgggattacaggtatttatattatttttatcaaaatcattagtgtgataattctccctggtttatccatgagaaaaccaagactcaagtggttaaatgaattgccccaagcacaaggctgatgcgcctggagctgggaggcttcctaagaattctctagtgaactttcccctttgcttctggccccatgctttcccccaccctgttctcactgtggctcctggcctgagaacagacctgctcaccagcagggagcttccagcaaccatcaaaaagcagtttgttggcagaagaatacatgcaggaggagacaacccaaaaagctttattggaggtgagttgagccatctgatcattgggagatatttgaaacgtagccatatatgtttttgccaatttattcaagaaaaaaataggatttttcagaatttttctacttgtttaagatattgttttttgttatacacagctttgaataattataataataacaatcacaggattagaaacagaattttagtaccagccttgcaaccagccactgtgcattctttgatgatccccatcattctccagcctttcccttcctctcagaggtctccaaggtccctcatgactctgaaggcctacatttgggacattctgatgaatccctcgagcaaagaggatcctccctgtgcctcaagattagtggccactgagagagttcccttgagctgggtacaatctttaaggactgacagtgttttaagaatgctaatttctggggttccatttaatgaaatgtagctttacgtgtagatctctctaaaggccagctgtaagagaattgccgtgtatgcatgatgtttcatatggttctttattgaagacacttaaccaggcttgtcaggaatacattggcattttcctatgccattaagaaaaccagtctcagctggaggggccagtaagtgaagcctgaggatgcatgacagctggtggttcagtacgtctgaccagctcccgtctggtgttccctgaagaggtgacattcagaaagacttctgcaaccaggagaaatgccctccacactgtatgtgaaggactcattaatcagtggcgtggccctaagtcagtattttcccttgcctgggtcttgctttttttcacttctccagtgaagaaatggttgacctcaaatgtttcttaaagttctaacagcctctgactgcaaatgtcacctaaaggcaatgccaaccttactttggtacaacaaaatcctaaagaaatggtcatggtcatgtgccatcacctccttcagattgacaattggaatactatttctcaggatgaacaggaagctgtgttcacaaaaggcatggttatgcaaattcggaatcagccaatgtgctttgggaatttctccattctaagcacatgcctcatcatcttaagccctttcagcagttctgggaaatgaggcttctcactgagatgacctgactgaggcttagcacaaagcagtgtcccatatcacagagctgacaaatggcagaattagagtcaaatctcaagtcttgtgctctattcctgtgaatcattcatgacaatattaaggtcacttgatgaataagacatatggccatagacatatgggaaaagattgtacgactgattggtatcacagacatcaccattcaacaagtgaggacagtcaggcccagcgtcaggctctgtatcccagtagttagacatcaagtcaagataactggagacagaaaagcatttttagcaggaaaataaccccaatacaaaatcacaatcatattgtcatattttaagtgagtggcaagcccgataattctgttttcagatgcagatcccattgaccaagtattcagttaaatgaattcttataggccccttctgaaaacagatacatcctgatggccacagaaactttgcccacccaccctcagttttctaaactgggatcccaatcagacccaagaaacacagcacatattctggaagacatcagtgatatggcttggctgtgttcccacacaaatcacatcttgaattgtagctcccataatccctacatgtcatgggacagacccagtgggacgtaattgaatcgtgggggcagctttttcctgtgctgttctcatgatagtaaatctcaggagatctgatggttttataaaggacagttcccctgcacacacactcttgcctgctgccatgtaagatgtgcatttctcctctttcgctttctgccatgattgtgaggcttccccagccatgtggaactttaagtccattaagcctctttttctttataaattacccagtcttggtatgtctttattagcagcatgagaacagactaatacaatcaagaaacctagaagggaactttaagccctgggctttattgcacttgtggctttggcttcctgagccgtacacccactgagattcagacttagatcttggtgatgtgtcctctgactcagtcctcacctagggcatcccaggcccaactttataggtcatatcagaaccttcaagatagcgaagacactctggctcctgtcctgcccccagctttgccctgcctttccctctctgggcccaggtcctttcctgcctcacttgtagagcttgtacattgttgtagtatgaagtgtggccatttagaatatcgagattctaaatcagcacattggctgattcagaatttgcataccatgcctttttttttcagcacagcctcctgtccatcctgagaaatagtatttcaattgtcattttgaaggagttgatggcacatgaccatgaccatttctttagtattttgttgcaccacagtaaggttggcattgcctttaggtgatactttcagagtcagtggctgtcagctctgcctcacttgtggagctcgtacactgtttcctgcctcactgcagccacagacatgtccatgtctgtggctctacatgagggaagctatgtctgctgccttttctattggcaatcccatttgtgacctactgaaatcagggcctcaggactcacaggaaggaaacacatcagtaaaagaccacatagccccttcctatctgagtaacatcagatgtgacttcacttctctgagctccaatgccttcatctgttgaatggagataagaatcctgcctaattcatagggattaaataagatgatcatgtaaggtgcctggcatggtgaccagccccagtgagtccttggcgagtgttattacttatgaatacacttcccacacgccttcacagaagtcctctccatgggggtcagggctcttctatacacactacagcatgcgttgccaggaacaagaaagtaagacctccagctttacttcataataagagacaaaatcaagaaggatgaagtgttatggaattgatgggcatggcattcttctcttttttatgactcttcctttcattctgcagtatttgcttccaaagctcacggtggcctgaggctgcaaggcctcatccaaggggctgatgtggacctgccccagggggctgccctttaaggccctgccaccctacattcacctggaaactgggcaatgttggaggggatgtctttaaaactaaggggagctgctggtcctctaccttgaaactgacccaaggtgatttagaaaactagtaggatttaggaaactagtctctgggttaacaggctcaaggttaaggaggcataaagggccttgatccaagggattctggggaaatctgaggtcagtctggatacaaaggagcattgttagatattctgagcccactcaagaggagacccaagtgtccaaaatgcaccaagctccctattccccttttgtggtgttatggagaatagctggaacctacatgcaatctccttgagtgtctcggcctggtacatggccccggttggaaggcctccatctctgcctgagtaaccaatgctgggcttcctaggcacaggccttgggcctgactgctttgggagtctcacacattcctagaggctatatttccaccctcaggttcagagtgttcaaggtggtttgtcattgacaactcttctacagccagggggttttgataagggagactgggtatgtctttgggcagggtcaccaccgtggttttctgatacttaccacaacattttcctgaatggctgtgcttcatactaaaacaatgtctagaagctaattgttaatgaattcagtctttaaaaatgtgattcatatactgggagatttcaggaagtgagtatcagatgataaaaatgcatgaacacacacacacacatgcaggtgtgtgcacacacactcactcgttcatcctgcaactattatgtgcaaaactcacataagctttcctttttgtgtttttgagatggagtttctctcttgttgcccaggctggagtgcaatggtggggtctcggctcaccgcaccctccgcctcccgggttcaagccattctcctgcctcagcctcccaagtagctgggattacaggcatgcaccaccacacctggctaattttgtatttttagtagagacagggtttctccattttggtcaggctgatctccaactcccgacctcaggtgatccacccaccgggcctcccaaagtgctgggattacaggcgtgagtcactgcacccagccaagctttttaattctttgagaatctggaggcaaaccaagtccccattgagtgtgatgtacattcacccttcttccataggaaatctgcctcttgggatgacaacaagtccttgtttaggggcagcatctcctgagcagaggcaggctgagtggtctgtaggtttgattgtgtcggcccagggtaagcctatagaatcactgaccttcagagatgaatggcaccatggagggtacatgctccatttctttcatcttccaaatgcaaagaaacaggcctagagacagaaatagacctgctggggtctcagctgctctgtgcaggaccaagcccagaaccatcctcactgctctgctagagccctttcccttcatagcacttgacgctcctctcagctggcagatcttttccagaaggttccattaccttacctttcttccatgatggaaataacaagaaagtaagtgacaatgatttcacatatgtgataggcaggtcctggaaagtgtgtctttttctcaatgctctttttcaatggtcagattctcttgggttaaaacaaaaaaaggtcaagatctctggatcctcctgaaggtcatagtcattctgcaaaatgggcctgacatttagaaaatatagatctgtcccctatcatgaagaaggcttttcagatatgaaaagtttacaggctttgggtctaagagtaaccaagataaaacacttcattggtttctcatctattgtgtaaattaatcttcagccctaaattgagattctgaagctgcaggagagagatgaacaacactggatattctgcattatccagttctaggtcactctctgggtctgccttggggtagtcctttcatttgggggcaagaaaactttttaagcctcagcttcctcacctatagagagaagaagaaaccgtccacttctcagtgttgttctgcagatgaggtacagtgatggaaggaaaacacccaggacagtgcgtggaagaccgccaggaggggctgagggaaggtagtttcccacccctgcccctgggtgggtgtggacctgcctctgcggttgggttgcttaaggctgagcactgtgctgaagccctagacccctctgaatccctcctgtaaaatagattctacagtctctacctcataggcactgagttggaagagggtgaaggagagagattcaagaagcacactaggtctagaacctcggaagaggcccaaggaaaataagacttaacctggtgttttaggcaagtcccaaggtattattgcccaagaggcactgaggctagtttgagtgagaaaaacctgtgtctccatgttttgtaagaaattaaatcagaatgtagaaaagcctaattcagtttcaaccaaatgagtagtaatattaactccattcctatttaaagctagaaagtacagctttaacagctaaaaggaggttgctgcggactaagaattacagaaggaacgcattttaatcggtacatttgcatagcctgttttactaggcaggatctggcccaaacacagccaattatcacacttaaactctccagagttcaaagatccaagaattaatatgctcggtgctgggattgtatattgcactgtctgtctgttgtatacacatgtagggcacatttgccaggcaggacacaactcagacagttggcatgcctcacctctgtcttgaatagaaacaggtcatctttcattggaagagaaaaatcaaggtaggggatggccgcagaagtcgaagctttgggaaaggcactgataattgtcaatgtgggatgggagtggctggtggctttctcacctttttactgacatgaacatccaccaatgtggatgtgtctttttgaccctccctagaggagttacatttcatggctacgcctctccttattagtcatgtttcatggctaatccttcctatgtcactttggtgttgcaaagtacaaaatgttggaccagttttctctttgcagtctgctctgaaaaccaggtgtcttcaagcacatcttgaagattaaggcagcctgtggttcctggacaccaactgtagagcaagtggcttatcaactcaaacaaagtgagagctacccatttcagcttgccactatgaaggcaagttgtctgaatcgtgaaagggcaaggagtattaaccttagggccagaaggatggcagctcctggaaagcagctgaggagcagaaagacactcaatagaagtgtaattgaaggatttttttcttttctcctacaattgaatagtttggttagtgttaacaggaatattttgctcccactctgcagcagggccagctgtctatgggtgtggacacccattgggagacaatccagtggccggctgcctgccttagaatctgcccccactgtattctgaaatttccaacaccagaattgtcttggagattggggtagtagtagcctcagaagcagctgttaaaatgcactgctttaacagcttttggtttcttttggtgagaaaaccaaagttcacacatgagaggtaactagtcatgcctggactcaaactgaattcctcatattgtctgtccaatatctatcacattatcccattttttcttattcccacggcttcggggagaggatgaagtaagaggtggttgaacattttgcatcttggcatcttctgttaatccataagccagctttgagagcccgccatggcaaagttcttcagccactttggggagtggacaatgagcaaggaaggggaagaaaagctgagtggcccatgtaccctaaaagtggggcaaacgtggaatcattggacagaaagagtctgcccagggaagctcaacaaagtacaaaacatcccagggcatgggcccttcctgcctctcttttctctctctccttacccaatgaccctccccaaacactccccaagagaaaataaaccctgactcattgtcatagccttggccctcttctctggagaggagatcgaagggtagattatagggctggcaaagcaggctgtgaggaaattccagttacctatggcctttcccttatcaatcagaaaggacagggcctggctagcatttttcagagcatcaaatatggaccaggtccatttttcataggcagtacttttttattatttattattttattttttattttactttaagttctgggatacaagcgcagaacatatggatttgttacatagatatatgtgtgccatggtggtttgctgcacctatcaacccatcacctagggttttttattgtttttatttattttattttatttttttttttagggaaaagggcaagcaggttttatttctggccaggcatggagaaggagagagcacttgctctaaagacagcttctcccagagcagtgggaagctggggaatgttacagggttagacgtgggtcaggggctatgtaagcttgtgttgggaagaacttcagacacgcaggtgcagatcaggaacatgctcttcatacgacacgtgtgcagaaagtggcagtgattctcttctatgggtggggacttttgcattataatgatacgctaatgatctaaaggtgacaggggccactggttctggtttgctctggttttgtgcaggccttatcctcctctgcaaagcatgctgaagttcctaggccatctggaattctttttttttttttttttttttttaatcctttaagttcttggatacatgtgcgaacatgcaggtttgttacataggtatacacgtgccatggtggtttgctgcacccatcaagccttcatctacattatgtatttctcctaatgctattctttccctagtcccccacccctcgacaggccctggtgtgtaatgtttctctccctgtgtccatgtgttctcattgttcaactcccacttatgagtgagaacatgccgtatttggttttctgttcctgtgttagtttgctgagaatgatggtttccagcttcatctatgtccgtgcaaaagacatgaactcatccgtttttaaggctgcataatattccatggtgtacatgtgccacattttctttatccagtctatcattgatgggcatttgggttggttccaagtctttgctatcgtgaacagtgcctcagtaaacatatgtaggcatgtctgtttatagtagaataatttataaacctttgggtatgtacccagtaatgggattgctggtgattgctggggattgctgggtcaaatggtatttctggttctagatccttgaggaatcgccaccctgtcttccacaatggttgaactaatttacactcccaccaacagtgtaaaagcatttctatttctatttctccacatcctctccagcatctgtttcctttttaatgatcgccattctaactggtgtgagatggtatctcattgtggttttgatttgcatttctctaatgaccagtaatgatgagctttttttcatatgtttgttggccacataactgtcttcttttgagaaatgtctgttcatatcctttgcccactttttgatggggttgtttgttttttttctggtaaatttgtttaagctctttgtagattctagttattagccctttgtcaggtggatagattgcaaaatttttctcccattctgtaggttgcctgttcactctgacccatcatctaggttgtaagccgcacatacattacatgttcttaggcagtatgttttaccaccagttcttacggcaaacttgagtggtaattatcagcctaatgtacaggtgagggaattaagggtcagagaggtgagttttcttgcttggagtcaccgggctggtaaaagcagagccagacttggactcagccctcatgggtttcttgggaaggctctgcccactcaccctcaggccctctctatgtcttcaggtaacttcacaagatgcagagcttctcaccattcaacctgttagttagctttgttttttacctgccttctctgagaacatctcccgtaatatgagttacagaaagagcacattttattctcttaggtcccttttcaccaatacagagccctgtggtattgacaactgatctcccttggacagggcaaaggatgtggggagatgaaggccaacctcctagtgtggagtggagggggctgaaaagtcacgtttgggaaatggttttttccattgacccttggctattattgcaggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggtaagggagaggctgctggtgatgtcctgggtgggtcagggccaggctggaatacctatttctgtttgaaatgatgagacttcactcctgttctgctctgtttactttgaaacctgcttttaatatctgtgactttccatggcttcttgggccatgcaaggaggggaggaagacaagtcccatctcaagatcagcccaaacctttattctttaacaagtaataaaagtagggtttcataactctcttccatgcagatttccctgcaggagaaagtgctgatcggtatttgaaatgggattgccagataaaatacaagatacctcattaaatttgaatttcagatgaacagcaaatgattttttagtacaagtgtgtctcatgcaatagttggaacacacttaaactaagaactactccaattttacaaaacaattcaaatgtaattgagtgtcctgcatgtttatttttactgccagatctggcaatcctaatttggaaggtattgtagaactggcttaaatgtttctaagccgttcataaatactcaggcgacacatttgcttggtgtgatgcttcctgtggtcttgagctgtttgtgaatgtccccttctttattatcagggcctaggaaaggtaggctcagaggaaagtagtgggcaactgttaaattgttaaattgtgctgagtttcttagacagagacatgaaggcactaagctctagtctagttttatgtctcaccaagccaaatcttgggactcccaatgtcttggacctagaaaactctactaactcagaattgaaagcctatgttcctggctttttggaagaaggaataactgaagtggcaatgggcttattagacattcagggtagttttttcagtttgcaaagcactcccacctacgctgtctcattggatttcaatgagagaggcagggcagataagaaaactagtgctcagagcgggggagtgactgccccaagatcacacagaatgtacatgtgggtctgggtctaaatacttgctgtgatgagtcccagacaagggcactttccaccacatcatgcttctgtctttgtagaaagaccaggaccagagcctgctctgtggccagattctcgagagaatctcatctcaggcttatgctactagggagcctaacaggtcaggtcttgggtaagctgatgagggagattggaggtggcacaaaaacaattaatgctctcaggcttatacctcagcctctaccttgtcatcaaagaaccaaaagagactttcctttctatacactttcctgggctgactttttgtttttataactgttttgggatgggttgaccttgacttatattttaagctgcttttatctggatggtgataggtattgtagggtgtgtgtgtgtgtgtctgtgtgtgtgtgtgtgtgtgtgtgtgtgtgtaggtgagtgctcttaacctgacagtgcatcagaattcttctggatatcttatagaaaagactgcctagatcctataacctgagattctgattcaatagatctgagatggagactacgtgtctgtgtattttacatttctactaggaaatttagcaaaaagtggatataatatacatgcatagattagagattacagcaaaaccaacaacacttgcattctcaccaccaaaaagccgaagaatctgaacattatcagtctttttggagtttcctgtatcccacctagatcacaaacttttccccaccctccaaggtaaccactctcctatattttgtgtgaatcacttatttgctcttcttcatggctataccacctatgtatacagctccaaacaacatattgactaggtttgcatgttttcacccttgtatataaatgggattaaattgtttttgatctgttcactttgatacatgtggctgtgattcatttgcttttggtactatattaatcctttgcataaaaatatcacaattgatctcttctaccgtcattgaacatttgaattatttccaggttcttgctattgccatcaacacaattgtaaacatttttgtacatctctcttggtgcacatgttcaagaatttctctagaacagggatccctaacacccaggctgaagactggtacctgtccatggcctgttaggatgggatgcatagctggaggtgagtagcaagcaagccagcattactgcctgagctccgcctcctgtcagatcagctgccgcattagattcttataggaacatgaatcctattgtgattataaaaacgtgaatcgtattgtgcactgtgcacacacacagactgtgcatgcaagggttctaggttgagtacttcttatgagaatctaatgcctgatgatctgaggtggaacagtttcatcccaaaaccatccgtggaaaaattgtcttccaagaaactagtccttgatgccaaaaaggttggggaccattgctctagagcatgtaactaagagtggaattgctgggtgagagggtcagaacatcttccatttcattgggtaatgccaatctattttccaaagtggttacaccaatttgtactccctctagtaatatattggtattcctccccatggctttacatcctcatcagtattgctattgtcaggctgtatttttttgtctgtctggtgaattaaatacagcatcccattgcagcttcaattttcatagaaatctgttttatttcatttttcataagtttcttggatgattctgaggcatagctgggcttgtaatactgttgacttactcccattcagacttactcccattcagccacccctaggactatctccagattccaacacttgacctctagaaacattttttttggtcgttacaggttttttaaaaatttatattccaggagtggaactgtgattacagttcagtgagatcaagagacagggacaagtggaaattgtgttctttgtaaattccacagatgttactgagtcacacatgataactttgaaagtttgtgctttaaagaaatgtttttaaacagtgccaataaattgtacatttcacttggtgacctgtttctcctcctccacctgtgatcgctgacatgcgcacaatacactgagtgctatgacaaaacaaaaaagaagggggggagaggagggaaggaagaaaataaataaatttttacttctcagcattctttagcatggaaacatatcaatgcctttagtttttatgaagctggatcccaagggtcagtgcacacactgaatgtgaaactttcccattagatgaatcaggattggaatatctgttttttttaaagtaaatgttgtcaacttccattgctctgaaaagtcatcactgttagcatcaggtagtagttagcaatactaaggatggtggtgtgaacaaccatagcaaaagctgctgtggatacaccagtctcctttaccaagctctttcatgaatggacacatccaaacataacttaagagaggctcaccactgtcagaaacttctgctaatttgtctggggtctaatggagtggtctgtactcacacagcatggatcagtcacggaaatgaggaggtcagcctcccagccctcccagaaaatccactgcttcagtaatggcactgagaggtgtttggagctttcaggagtgcgtctctcatcacttttgtagtcagttatttataacactacctttccctgaagtagcgttgttcctcatgaagcagcctattgtaataaactcccttgaccttcagggaaagaagtgaaggttcaggaagagaaaacaacctgtccattctgcacaatggccaagcagtgtcctatattccaatcctaatcccagagctttagagtctcagtttcttggtcattttggcagaaagggtgctggtggtgaagatgagaagtggggatgggttgcctttagtattatgtagtcactagtttgttttctaactcaatattcatgggtcagatagtatttagatgctattgcaatatttcttgtcagttatagaaggaccagaaaaaggcagcaagatgataccaatcaaagataatgaactataagtgtataaatcctgaatggttttaatttatggcctctgtagctgagaataataaggaagatacaattcagagcagcaagataataaaaagtgatcattttgatggaacataatattataaattactaaaatcttgaagaaccatcagatggaggcattctgtgactttttaagaagtgccaggggccatgttgatgtctaactgcttccggtgttttggaatatagtcaaaggtatttttcttctccagtaaggcaagattttactctgtagcatgaatcctggcttaaaaatggaaaacacactctcagcccatctgcagagccctctccccagggcctcactcatgggcacacgcagaaaagatggaagcagactccacagtgaggaggctcctattcttcctggaacagctcaactctctccccgtcctctgactctcaggtttttgctttgttttgttgtgcttttggtggagggtctggatgcagcactgctactgaggttcttctgttcatcaagatggcttcattttcaaaagatggtgaaacaccatcctggagccctggagtggctaaggatgctttcacacatgactagggtattgcaacagcagaatggggtcattcaaatttttgatgcactcctgttgtacccttgtgtattagtttcctgtggctgttttaacaaattcttacaaaccggatggcttaaacaacagaaattcattctctcctcattctagaagccaagagtatgaaatcaagatgtctgcagggttagtacctcccggaggctctgaagagaaatcctttccatgccccactccagcttctggcattgccgggaatccttggcattccttagcttgtagatgtctcactccaaactcttcctctgtcatcacatggcatacctcctgtgtccttgtctgaaatctgtatcttaacgggacatgtgttatcggattgaaggcccaccttaagtccagcatgatctcattctggaatgcttgataacatctgcaaatactctattttcaattaagttcatcttcacaggtacacaggggttaggatttggacatatgccctgggggccactctttagcccactatgccttggtttttctccccctgcgtctgggttggcatgtggatcccatgcatctgtggactgtgaattcttagacccttcaggaagtctgattagacaggttcagaggagaccagattcataccagcatttctcatcctttcttcaatttcttcccctaccccaaaagtttgccatgttcttaaaagggtccctgaacacctctcaagtgaactgtatcccaggagtagcagggacctgagtcaccttttgaactgcaagtgcagactttgcgggaaaattctctcaggatatagcctcctttgcacccacagtcactgcaggctgcaaataagtggctgagctgactctgagtctcacctctgactcttgatcttttgaggtattgataggctatggaatgataaagggctgcccagcatttcctccttcatcagtgaaactcatcattagccacccatttctgagttcaggcttcatttgctgattgatggggacctctgacacctacatgtgtatgggtttgccactgtttctggagagcaagttccctaggtgaggaagggtaggaggtgtcctcatagatgaggacaggctgtcagtaagatggagacggacgaccttcagagctggagaatcactgatctttctcccaaaagtgctgccattgtccctgctctgcaccactgcagagtgaaatgtgctagtgcaggcttcaagtccggcatttatggcccacagggttcagtggccaccctgaagttcatctcgttaatgggagtcaataattacacacttcagtttgtctgtaggaacaacctttagcaaacctcttattttagaaaaatgttgaagttggggaaacagtcaggagaggtaagaaaactggaatagaagaaaaatgtaattggagtgaccgctgatcacacacacagacacagacacacactcatgggcagaacaatattcctttcttttcacttgtttcaaaccggatgatctaaactgggactacccttgccaggtattcacaggctgcagctccccagagctcccttcctgtgctgctctgttcatggccaagtttctactttaagttaatggtttctaaactttattctgttgtatgccccattggtaaaatatttttgagcatgtactcctaccatgttatattcatcaattatatgcacttttgtgtgcctaactgtataatactatttattagcaaaggttttcttttctcttttagataaaataaatatagccacacatctgtcctctataaatggaatcagacttccttgtttgctaagtcatcttaccctggccccaacgttcctgatgtctctgtcccttttccagtcctttaaggagcatttttggggcagtgttctcctggtccactctcttcccattgcatgggctgtgctggccagggactccttcaccagtaaggcctcacggacagctctagcccctgtgttccctcttaagtttcaaagacctttatcctcttttcttagaatctacatcacttggagaggaaagaaagaacttcttggttgaatgctactgacaacactaactctccaaagtcgagatatatctttatagaaattcttgtttccatttcaactgacatacctaagatgcaggctgcaaccaatatttcctactggcttatctaaaaaactatcttggtgctgtttatgatggtgaaaaactagaaataacttaaatgcctaaaataaggaattagttaaataaaatatagtatacctaaaatattataccacaattacacatatacattgtaaaaatattgaataatatggggaaatatttggaacttattattaggtttcaaaaagcaagttaaagaatgtgtgtagtagaaattgtttgtaaaagaaaaaaagaactatgtacataaggataaagtctgtaaggaaatataccaacacagtagcagaagttatttctaggtaaattaattattagtgattttcatttccttctgttgcttttgctattttccaaatttgagttcattgtcatatattattttttataataagataaaacatgctatcctttttttttaatacaaaggaataaaaaattatcattcgagactattctattgagttatcttagactttgggggaaaaacgttaactattttgtgccacaaccacagtcaaaaaagcctagccaaaaatcctggctaggatgcagtaggcaagcagacagacaagcaggttattttcctgcctgcctgcctagggacagcacattggcagctggcatgggctcccaagtccagagcaccccaccccctacctctttctgcttggcttatccttgaagggtaggaagagggaaatgtggaaaataagtgtgcagcaggctcaggaatatacccaggggccaatcccagcatctaagtaagagtacagaaacacacccacttcagttcaatttttgcccctgcagacttaccaagagggctctgggtgcttatgcttttcatttgagcatgatttctcatcatactaaggtcactgggtggatgtgtggccttctatctctgcccgtcttttggaattcaccaggaaagcccacattagttctctggttctgtttgtagaaacacgtcactcgtctctcaagcaatacagtccctggcccttagatctggacccttgagcaatcacatcaacaagttgtgatgtgtgattctttccatctaatgtgattctgatacaactagcagctggagcttggactcctgagaagggttgccttaatgagtggcatgcttgcctcaggggtggaccttccagggaagtattgttcacctccccatcaggacaggcctttcctggggtgttgggatggattatagatgtccagtgaacaaggaacccctcctaactgaacctcatgggtctgcccacagggagatagggagataggcatgtggagcaaggaaagaaggactggctgggggagcagaggcctggctctggtcccagctctgccattaggagcatcactttacctctctgggtcttgagttcctcatctgttaggtaagatcttagactagatggtcaataaggccatttcctgctctaaggcaaggcttaggcatatccaatacaaatgatggccaaatacctggcataaaacctgtgaggcacagaaatctctaccagcccagggagagagacccacctcctaaggtttggccatggtttctggaatctaaacagcccagtgattcaggtcacactttgtaccacagagccaagataggatcattgcctccagaaaccctagtgttttctctggaggaaggaaagaggaactcctggcccatcacagcagctgaacttgtcagattagattctagaggttcaggagcctgaggagggatcacagcatagagataaaaactagtattggcaaattaatgcttcctccagcccccaacaagatgccccgatccctagaacctgtgaagatattactttatagggcaaaagggactttgcagatgagattgtcttggatgatctgggttgacccagtggaatcacaggggaccttaaaagggaaggagggaggcaggagagtcagtgtcagagaaggaatgtgaagaaggaagcacaggtcagagagagatggagatttaaggaggtcacattgctggatttgaagatggaggaagaagccgtgagaggaagaatggaggtagcctctaagggctgggaaagaagaggacaaggattctacccagaagctcattcagaaggaacgcagttccaccaacccattttagacttcttacctgcagaaccaaaagataatatagttgtgtcattttcagccccccactttctggtaatttgttactgcagcaataggatactaacacagctggccttgaccaagtcggcaggaaaattgacatgctcttggggccagggccagggccagggcttacctggggcacgattctagaaggaacaaggctcagaggactgatggggacttcaagacaaactgacttacatatattgaaggtatccaatgaattctggctggaaatgcagtccttaaactgtctcctccactataaacagaataaacttctctatggacaagaaatgggaaagaaatacccaaggggacaaggagctgaggccagaaataaggagatgcatctgggagtttggctcttgtaaggcaagaagtaccgaaagcacctccagggagggtcctggagaaggcacattgctagaaatggggcacctgggataaggctactactttacctgtagagagagcctgaaggtgctgtaacagctgccaagggctcggtttctatgaagctcctgtctagggtggttggaggaggcagtgaaactacacacacaggggctggggtgagctgccaactggctcataaatgagccccgtttcctgtcccaaatgaaactggcaagagttgcagactgtaaagtgcttctccagccacagtcacaattgattcctataatatagcaagataggtatttctaagttgtagatgataatcgaagatgaactagtaagtttcaaagagaggaagctgagtctttctcattcattgcagtgttccaagagcctagcctaagcctccatataaaataggcattcattaaatatttcttgacctatagttagaagctcggagaaatgaagtaagaggttcaaatctccaaagccagtatattgcagtcagatattcaattccagtttttgaacacccagtcttatgttcttaccattatgacaagctcttcttaaagcacagtgcttcccaggcctgtgcctacagaagactcaccctcattagatatctggcagtacattcagaagtttggggcatctcccagataccagtgatactggggtgtccgctttgtcctatgacacaaccaaattacatcaattggggtgtctggaagtgccgtgtcttcagaggggtcttgggaagcccactgtcacctgtgtcttctttgcagatggccaggttgaggagtgctgtccaaggcagccacagcctaaaacttaccagccatcccggccacacagagatgcaatccatgtgaggaagtggaatcgattactgccaccagctaagctgtttatagtttccctgcccttttagaaatggaaggagccctgtgctgagagttgagtgctgggttggcgttggctgacacgtgacatcagacctcagtctctaaattggtgaattgagtgggtgggactagatcatctataaaagtatgtggagctgtctttttgctttccttacttcctcgtattaagaagcttttattaatgttatctgagttttttagcctcactgatttctatatatcaaataatacagataagacacatcctaaagaaaaatgggctctgcttaagaaaagtcatgaaccactctgaatttatgcttgaagggatttgaaagaaagccgggaccttgcaagaaagaataaaataaaattcttttgaatggggataactacagaattattctacttagagtggaaagataatctttactcattcaagatagagaaagactggttcaacgtaagttgaagagggatctgggggtcattttacctctgtggctccctttcctgacttgttataaaaatcaatcaaaataatgcacaagagaccattctgtaaacaggaaaatggcatagtggagtaacacacagccctgcctgacagcagtcaaccagccacagcagcctgaagcaagtggtgctgctctgtcttgatttaaggatcttgatcctacaaagcaggcttactgggcccaggcattcacatataacatcatatctgggaatggggggtgggttaaactcaaaaattttggacatgacaaaggatttgctgagaatgaggagccctcacctgaggcagtaatcatgcacatttacaaatggaagtgcagcaagcttgaaagaatacacagggcttcagatctcactgtccagctctttctactaagtgattggtgaggacctttaacctgcatagcaaaggttgtggtcaggttattcttatctaatgcattatggtccactttgaattttctacatcttgctttgggatccttactggtgattcgtagtcattttttttgtttttgtttttgttttttgtttttctttctttcttgagacagagtcttactctgttgcccaggctggagtgcagtgacaccatctcagctcactgtaacctctgcctcctgggttcaagcgattctcctgcctcagcttcccaagtagctgggactacaggtgtgcgccaccacacccagctaatttttgtatttttattagagacggggtttcatgatgttgaccaggttggtctcgaactcctgacctcaagtgatcctcctgcctcggtcacccaaagtgctgagattacaggtgtgagccaccatgcccagccttcatgcttgatcaaagtacctgtgttgagtattactcgtaagtacatatgttgagtattactcctttcctagttgattcttatggaagctgttagtatttggaaatatgcgagatgctgtgtttacttgttaatgaatctgatagcatgcatagtgtggcagctccctgtgtctcttttctggagcaccatgacttgtatttgtgttatatttggcaacctccttctttctgttgtgatcagcatttgttgcatctagaggcaatgaaggaggtatttgaaatattttgctaagaatggtgaattattcttaggcaaggtgcctacaatgagaatagtctttcggttatatattgccatgacactaaagtagatagacattaaatttacttctgcaacaacagcttgggatgcccctgtttaatccccttatatccaatattgcttcagctaagcaaacataaagtattattaaagtatcattatgtagattaaataatcttcctctcctaagaattatttttcttcatttattaagacaacacattgatacccaaaaggaattcattctatagtggtatgtacccaggcagtgcagtgtgggagaactcagtgcagtcactgctatctctcccatgtccaagctctaaacacagattatatcctatttggagcctttaactgtaaaataggtcagagcactgggaatataaaaaaaagagtcatcaaaataattaatgctttcaaaatgaggatttgagagaagacaggagtctcagtgcttttggctaggcagttctctagagagcatccataattgcccagccctcaaatgagtgcttcattcatttctctcatttttgctgtctgttacttttccatctctcttctatcccagtgttctctcttcctcttccctcctcaatctctttgccatcaaaagcctaaagtattcttcccatcaacaactctggaaacagaataggcagaaccagcaagattggctgacatacagactaaatgggctggccctactaataaaaacaaattcagacacctgttggtcttttgtgtgacacatatataaggacaaatttaggaaacattgcttgctagagaaacaagcttagttgcctaaattgataagagaggtgaattccagaagcctgtgggaatgaggaaataattaaatagagtaatatttttaaagtaagctggatcaactgggttctgtgctcctgagatcaaagacaggatgaaaactcagtgtccttcagaaggaaatcacatgtctagatggagtgaaataaagatgaggttgagggggggaagggggtaatgtacatgcccaggggggttgtaggtgaaagtgataatctcagagggaagtgggatggggctgggatagggaaagaactactctgctagcctgaggctccatttatggctgcatatattcccaatggagataggacagagtctgaggtagccacagccttttagccaatcctacggttgtgtatatgcagagcagacactcaagaactaaatggcctgaacattaaagtgcattcctcctccagatttttaagacctgacatacgcaaagcaagaaaagaaacacattatcttacctatacacagatctattgacagatgacagaagtcttactgacttaaggaatataagcccatcatctgtaaaaacatttgccaatcactaaggaacataggaagtacccatagaaatccaggcttaaaaatcaaaacagctgggtatggtggcatatgcctgtagtcccagctactccagtggctgaggcagaaagaatgcttaaaccccggagttctgagctgtagtgtgctatgctgataagtgtctgcactaagtttggcatcaatatggtgacctcacaggagcaggggactaccaggttgcctaaaaaaggatgaactggacatgtcgtaaacaaagcaggtcaaaactactttgctgatcagtagtgggatcatgcctatgaatagccacagcactccagcctgggcaacatagcaagaccccatctcttttttattaaaacgtaaaaataaaaataagcacctgaaaaacaatcaatagagacatcagcctacacacactgcagggaagacagacttcacagatagaacccagccaagttactaaatgaagaaacaaaactaacaaagatagcaaaataaaacaactataagaacaagaaaagaacctatggcagtcttcagagggaaatatcagaatccagaattgctgtaatacattttctaaaatgttcagttttaacaaaaatgagaatatatacaaagaaataatacaatgtgactcataagaaaacaaaaagctaataaaactttctgaatgtcctcaactattggatttagaaaataaaaccttaaaagtagctattatgaatatattcaattaaaaacaacaaaaaagtttaaagaaataaagaacagcatgacaacaatgagcaataataactgaaaaactgagaatttgactggacagaaaaatcttttaaaaagaaaccaaaatggaaaatcttgggttggaaagtgcagtaactaaaatgaagaattcactagaccagctcaacagcagatttaagaaggcagaagaaattttaaaatgtgaagacaagccagtataaatttttcaccctaaagaacagagagaaaaatgttttaagaaaaatgttcagatcctaagaaacttctgggacaacatgaagtgttataatatgtgtttaatagaagtcctataagagagaaaagaaaaggggggcaaaatttttttgaagaaataatggcctaaaacttgccaaatttggtgaaaaaaatcaatttgcacatccaagtgcctcagaaaatcccacctagaataaatacaatgagatctacatctagacatatcatcatcatattgttaaatgccaccaaagatcttaaacaacaagagaacaatagcttatcatgtacagggaatattgaaatgattaatggctgacttcttatttgaaacatgaaagactaaaagacagtggaacacatattccaacatgttgaaagataagaaaaaatgtcaacaagtttttgatatcaagcaaaactaacctttaaaaataaagacaaaacaaataattcccagaaaaacaaagacagagaatttgttgccagcagacctgttttacaataaatactaaggaagtgtttcaggctgaaatgaatcataccaggagctaacttgaatccacggggagaaatgaagagtactagaaatagtaaacatatgggttaatataaaaggcttaaacaacctttttcttattcttctcttaacatcttaaaagacaaaattatgtaaatccacaattataaaactatattgttgggttgataacatatatagatgtatataggacaataacagcacaaaaatggagagtagaattagattggagcaaaatttctatattttagtaaaattaggtaatattaatcttaaatagactgtgataaactaagatgcatgttgtaatttttagagcaatcactaggaaaataactccaaaatgtaagagaaagaaacagagagaaaagaaagaaagaaaaagcaaggaagaaacaaaggaaaaaatgaaagaaaataaataaacgattaaaatggtacgctgaaaagtattcagtgctgaaaaaaaaggaagaaagatacagaggaactaaaaaacacacaagatcagagattgtcagactacataaaaaggaagatgaaatgtatgttttctagaagagggacactttagactcaaatactcaaatagattgaaagtaaaaggattggaaaagagatatcacacaaacaattaaccaaaagaaagctggagtggttgtattaatatcagataaaattaagacaaaaatatactaaacagtatattttataatgataaaaatgtcaattcaccaggaagagataacaattataaatgtatgtgcatcaaacaacagggccacaaaacacatgaagcaaaactgttagaactgaaaggggaaacaagacaattcaacaattatagtgggagatttcaataactcccaaaagtagaacaactggataaagaaggatatagaagccttgagcaataacatcaactaactcaacctaactgacaaataaacacctttccacctaacgactacataatacaaacctttcaagtaaacagagaacattcttcaatatagaccatatgccaggccataaagaaagtcattaatttatataaaattatacaagtataaaattatacaagtaaaaaatcagtattatataagtaaaattaaaattaaatttaaatttaattaaaattaaaattatgcaagtaaaatttaaaaagtatatccttcaatcacaataaaacaaactaaaagttgaccactgaaagaaatctcagaaatccctgactattaggaaattaaataatgaacttctaaataaacatcaaagaaaaaatcaattgcatgggaaatagaaaatatttcacctgaatgaaaattaaaataaaacatattaaaacttatgagatgaaatttaaaagtgctcagagaaaaaaaagtatagctttgaatgcctatattagaaaaagagtaaagtctcaaatctataacctaagtttttattttaagaaattagaaaaatcaatgaaaacatgcgatgtaaaagcatgcagaagaaaggaaataaagattgagtagaaatccatgaaataaaaaagcagtagtaagaatcattgaacccaaaaatttgttatttgaaaagaataacaaaattgataaaccttttattcagattaatcaagtaaaagagagagaagacacaaattactaattcaggaataaatgagggaccatcactcttgaccctaaagaatttaaaagattgtaagggaaactaaacatccttttgccaatatatgacaccttagatatgacaatatatgacaacttagataaaagggacagatttctagagacacacaaattaccaaaaccaattcaggaagaaatattaaaatctgaatagacttataacaagtaaagacttgaattagtaattgaaaatctaccccaaaagaaaagtccagacccaggtgccttcattggggaattctaccaaatacttgcagaataaattatgccaattattgacatattcttttagaaataaaggaatgaatacttcccaactcattctatgaggccactcactattcccctgatcctaaatctaggaaaatagatgtgacaaggaaagaaaacccctgatcgatatccctcataaaagatgggtgcaaaaattcttaacaaaatattacaaaccatatttagcaacggatgaaaaggatgatacactataaccaagtggaatttatttaggattgcaaggttggtttaatatcccaaaatcagttgatgtaatataccatgttaataggataaagtacataagccgtttggctatctcaataaacacagaaaaggcagttgatagaatccaacatccactcatgatcaaatttctctatgtactaggaatagaaggtaatttccttaacctaataaagagcacctgtgaaatacccatacctaacaaacaacataataatgaaagactaaaagcttgtctccaagattaagaataagggaaaaatacttgctttcatcacttgtagtgattgagcctagccaatacaaaggaagggaagggaaggggaggggatgggaggggaggggaggggaggggaggggaggggaggggagaaggaaggaagaagggagggaaggaggaaggaaggagggaaggagggagagaaccaaaaacatgcagatatacagattggaaaggataaaatagggagggagggaactaaaaacatacagatatacagattggaaaggataaaataaaattgcctttattagcagataagatgaattttaggtagaaaatcccaaaagaattcacaaaaaatgaaagctaatttaacaaacaaatgaatttaccaaggccacagatacaaaatcaatattaaaaaactaactgtatttctatgttctaacaacaatttccaaaagggaattaagaaagtaattccactgacaagatcatcaaaaagagaaaataattagaaaaaaatttaacaaaacaagtgcaagctgcatacattaaaaattgcatattgctgaaattaaagataatataaattaaaaaaagagacattacattttggaattgaaaatatcaatagcttcaagatggtatttctccccacattgatcaataagcttaatgtaattgctatcaaaattccagtaggcttttttatttcgtaacttaaaatttatatggaaaagacctggaatagacacaatattttttcaaggaacaaatttggagaacttctactacctgatttcaaaacttactataaagccaaagtaatgaagacagtgtgatattaaagaaaggagaggcttatataccaatggaacagaaatgagagtccataaatacatgtttaatttataatcaactgacttttgacaaaggtgcctgaggtaaaagaaatggtgctggaataattggatattcatttacaaaaaaatgaacttagaatatgacctcataccatacacaaaaattaactcagaatttaagagccaaaagtatacagtttctacccaagaaaatgaaaatgacagaacatctttgtgaccttgggtggggaaaaacgtttttaggtatgatgctaaaatcacaatcaatgcaagacattgataaattgtgcttcatcaaaatttaaaacttttgtgttctaaaagacaccattaggaaaatgaaaaatcaagccacaagactgggagaaaaatttgtgaatcatacattgcataaaaaagtgtatccataatatataaacaactcttacaaatcaataataagactaaaagctgaattaaaaaataagattcaggccaggtgccatcacccacacctgtaatcccaacactttgggaggccaatgcaggaggattgcttcatgccagaagttcaagaccagtctggtcaatatagaggggtgccatctctacaacaaaatttttaaaaaataagatttataaaacttacctcaaggggatttaataagaattaaacaaaataatacactaaagctcacattgcacatacactaaagcaaacattggcacaatgtttgctacacaggaaataatcaatgaacagcagcaagaggtatactcagaaaggtatactcattattttgtaaataaacaaactgagctgcaaagaaggtaaagaattgtccgaagacatacagcatgtaagcagcaggcatggatccagctgtaactttcagtatctaagaaaaaaaaattcacaggtgattttcacactggatgagggaaagatgttcccctgggccatcctatccttcaaggtactgagggttcggacctccccctggtctctgtcccatcaggttttgctggtagggaaggttgggggcaaaggaaaaggaagacgcaggctgcctttaaggggaaactctcaggatctcacagttgtcactctttccttcacttgattttcaataactgtttaaatattattatagttcattgtcagaattatgtggaatagagaaaaaaatagaatctgctttaaatgtgcatcaacagtgaactggccaaattaattaggatggatccataaaaaatttaattacaaaagcaatgtatatttttaaaaatgttaaataaatattatatacactaacatggaaaaatattgatatagtttaatgaaaatgtaggttgttaaacagtatgcatattatagcctcattttggtttgtatatgtaatttaggcatagaaaatgtcctggaagcactagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatcctgaatagacaaataacaggatctgaaattgtggcaataatcaatagcttaccaactaaaaagagtccaggaccagatggattcacagccgaattctaccagaggtacaaggaggaactggtaccattccttatgaaactattccaatcaatagaaaaagagggaatcctccctaactcattttatgaggccagcatcattctgataccaaagcctggcagagacacaaccaagaaagagaattttagaccaatatccttgatgaacattgatgcaaaaatcctcaataaaatactggcaaaacgaatccagcagcacatcaaaaagcttatccaccatgatcaaatggtcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactcccaataaattaggtattgatgggacgtatttcaaaataataagagctatctatgacaaacccacagccaatatcacactgaatgggcaaaaactggaagcattccctttgaaaactggcacaagacagggatgccctctctcacctctcctattcaacatagtgttggaagttctggccagggcaattaggcaggtgaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagcaacagacagagagccaaatcatgagtgaactcccattcacaattgcttcaaagagaataaaatacctaggaatccaacttacaagggatgtgaaggaactcttcaaggagaactacaaaccactgctcaaggaaataaaagaggatacaaacaaatggaagaacattccatgctcttgggtaggaagaatcaatatcatgaaaatggccatactgcccaaggtaatttacagattcaatgccatccccatcaagctaccaatgcctttcttcacagaattggaaaaaactactttaaagttcatatggaaccaaaaaagagcccgcatttccaagtcaatcctaagccaaaagaacaaagctggaggcatcacactacctgacttcaaactatactacaaggctacagtaaccaaaacagcatggtactggtaccaaaacagaaatatagatcaatggaacagaacagagccctcagaaataacgccgcatatctacaactatctgatctttgacaaacctgagaaaaacaagcaatggggaaaggattcccaatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgtacagcgaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaagtagaaataccatttgaccgagccatcccattactgggtatatacccaaaggactataaatcatgctgctatgaagacacatgcacacgtatgtttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggagcatcacactctggggactgttgtggggtggggggaagggggagggatagcattgggagatatacctaatgctagatgacgagttagtgggtgcagtgcaccagcgtggcacatgtatacatatgtaactaacctgcacaatgtgcacatgtaccctaaaacttaaagtataataataaaagaaaaaaaaaaagcagaagccactgtatatttcctgcagaaggtatgcagggaaacagaaaatgtatgaaaaaacctccctaaataaaagacatctgagactctaattcaaatgaaaaaaaaaaaaagaaaatgtcctggaagcatgtataccaaactattattgccaattacttttggagagtagaattttggttggggaactaggaggagaatacatttttgtatcattagaatttttacatatttattttgtaattaaaaactaaaaatttctttaaatatttatatctaaaaatgctatttgctttctattaagaaaaggagacttccagttttaaaatggtggtgtagaagcaagctggttttactccccacaccctgtagaaaatcaaaaccaaagcactgagattttcactagcaacacttgaaattcaaacatgaggatcagacaggtcccaggaccacagagaagtgaaaatattctaagcaagtagtaggagaatcagactttcacatctgtgacacccctaccccacaattttcctggcaacaagttcatagaaaatctttcctcattcacaatttctacactggaaaaactgaaattgaggtggtcaaccagcttctccaccttcttagggtctctttggcaggagatctgtccttcccttaatgcacaggaagcattgtgattgtctaaagggaaaaatatccctaaggatgggcataggcaaaggtaggactgccgtctccagccatggaaactctactctgtaactcagccaaaggagatgccaaatcaatgtggctgttcagcagcatcatgcttaggaggcacatttcacaggttccctgggcacaaactgctagccagccttcccacactactgggtaatctctttgagacctcccccatttggaacaggcagcactttgactatttattagcgcagaggtgaacctgggcttcacgtgctacttagaaccaaaaaggaggcagcaacctataggtaaaaatttgctaagcaaatatatccaataaaaaacaaaacaggccagagagagaaaactagaataaaaaactgatctttcaatgcaaagatataaacacataccaacacaaaacaacagctaacagggaaccatgacctaccaaaaggacaaagcaacaatacagtgactgaccctaacaaagtggccatttgtgagctccctgaccaataattaaaaatagcattttaaaggaaacttagtgatctccaagataacacagaaaagcaaatcaaaagtttatcagagaaatttaacaaaaagattgaaatagtttttaaaaataaaacggaaaccttagaactgagaaatacatttgctgaagtgaagaactcattagagactctcaacagaaaaatcggccaagcagaggaaaaatcagtgagctcaaacactggctatatgaaaatacacagtcaaagaaaaaagaacaaaaaggaatgaagattgcctgtaagatatagaaaattatctccaaagaccaaatctaagaattattggtgttcaagaaggagccaaggaagagcaaggggcataaagtttattcgaagaaataatagcagaaaacttcctcaaacttgggaaatatacaaatccaaggtctatgaacaccagaatcaacccaaataagaccacaccaaggtatataataaccaaactctcaaagttcagaaacaaagagaggatgctgcagtcatcaagaaaaaaaactgaaataacatataaaggaactccaattcatctggtaacagacttctcaacagacttctaagtaggccaggaaggaatggaatgacattttcaaagtgcccaaaggaaaaaaattctgccttccaagaatactgtgctcagcaaaattattcttcaactatgaaggaaagctagtccttcccagacaaataaaagctgagaaacttcatgaccaccatactcttcttaaaagaaatgctaaaggtagttcttcaatctgaaacaaaaataaacactaacatgcaaaagaaaaacatttcaaagtgaaaaacccactggtaaaattaagtacacaaataaacccataatactgtattgtaattatggcgtgcaattcacttataactctaatatgaggcccaaaagacaaatctgtcaaaaacaataatagctacagcaacctgttgagagataggtaatataaaaatttgtaaattgagacaactaaaattcaacatgtgggggatatggagttaaagtatagaattttttttttagtttttttttgcctttgtttttattcttctatttgtgatctaagataagttatctctttaaaacaacttattattatctataagatgtttttgtaagcctatggtaatcacaatgtaaaaacctatagtagaatcactaaaaataaaaagcaacaaattaaaacacactaccagagaaaatcacttaaccacaaagggaaatggtaagaaagggaggatcttaaaacagccagaaagcagagaataaaatggcagtactgagttcttattatcaataataacactaaatgtaaattgtctcaattctctaattaaaaggcatagagtggctgaatggataaagaaataaaattcagctatatgctgccttcaagaaccccacttcacatacaaaagacacacatagactgaaagtgaaggggtgaaaaaagatattccatgcaactggaatccaaaaaaggacaggagcagctatatttatatcaggtaaaatagactaaaaatctaagactgtaaaaagagacaaataacttactatataaagtaaaggggtcaaattcaagaagaggatataacaattataaatatctatgtacctaatatcagagctcccaagtatataaagcaaacactaatagatctaaagggagagatagactacagtccaataatagtaagagactttaacaccccacttttagtaatggacagatcatccagacagaaaatcaacagagaaataacagtgttaacttacacactagatctaatgtgcctaactgatatttgcagaacatttcacccatctttgctgatatggtttggctgtgtccccaccaaaatctcatcttgaattgtagctcccataattcccatgtgtcatgggaaggacccagtgggaggtaattgaatcatgggggcaggtctttcctgctgttcttgtgatagtgaataagtcttacatagcgtaaaggggagttcccctgtacacactctctcttgcctgccaccaagtaagatgtgcctttgctcttcctttgccttccaccatgattgtgaggtctccgcagccatgtgaaactgtgagtccattaaacctctttttctttataaattacccagttttgggtatgtctttattagcaccatgagaacagactaatacatgtgcagaataaactaatcaacacgtggaatattctccagaatagatcatatgttaggccacaaaacaaggctgaacaagttcaaagaattcaaaatcatatcaagtatctttgctgcccacaatgggataaaactctaataagaagagtaaccttggaaaatacacagacacagaaattaaacaacatgctcctgaacaaccaatgggtcaatgaagaaaataagaaggaaattttaaattttttgaaacacattaaaatggaaatacaacataccaaaatctatgggatatgacaaaacagtgctaacagggagtttatagcaataaatacctatgttttaaaaaagtaaaaagacctcaagtagactaatgaaccccaaggaaaagcaagaataaatcaaacccccaaactgaaaaaaataataaataccagagcagaaataaatgaaactgagactaaaaaaatacagaagatcagcaaaacaaaaagttatttttaaagataaacaaaattgacatttatctagactaagaaaaaaagaaagaatactcaaataatgaaattagaaatgaagagggggacataacaactgatacctcagaaatacaaagaattattagagactattatgaacaactatatgccagcaaattggcaaatctgaaagaaatggaaacattcttggacacatacaatctaccaagatggaaacatgcagaaataaaaaacttcaataaactaataatgagtaatgagattgaagcaacaacaaaaactctcctttcaaagaaaagcccaggaccagatggtttccctgctgttgtgtaacaaacatttagagaagaattaataccaattttgctcaaactcttcaaaaaaattgaagaggagggaatacttccacatttattctatgaggtcagcattaccctgatagcaaaaccagacaaggacacaagaaaagagaactacaggcaaatatccctgatgaacatagatgtaaaaatcctcaacaaaatataggcaaatctaattcaacaatacattaaaaatattattcaccatgaccaagtgggatttatcccagggatgcaaggatggttcaacatacacaaatcaataacatatcttacacctagaaaaacctgaggactccaccaagaaagcatttgataaaatttaatgtctctttatgacaaaaatcctcatcaaagtggagatagaaggaacatactgcaaaataacaaatgccatatgtgagaaacccacagctaacattgtaccgaataggaaaaaattaaaagcctttcctctaaggaatggaacaaggtaaggatgcccagtttcaccagttttatttaacataacactggaggtcctggccagagtaatttattcagagaaataaataaagggcaccaaaattcaaattagtatagccactatggagaacagtaagaagtttcctcaaaaaactgaaaataaaactactatatgttccagcaattcaactactgggtgtatatccaaaagaaaggaaatgcatatatctaaaagacatctgcactctcctgtttattgcaacactattcacaatagtcaaaatatggactcaacctaagtgcccatcaatggataacgaaaatgtgttacttatacacaatggaatactatttagccataagaaagaataaaatcctgccatttgcagcaacatggatggaactgaagacagttatgttgagtgaaataagccaggcacagaaagacaaatattgcatgttctcatttctatgtgggagcttaaaaagtggatctcatgaagatagagagtagattggtggttaccagaggctgggaaaggtaggagaaggggggtgaaggggaagaatatatacatatatagaaactatattatatatatagttattaccacttaactgtatacttaaaatagtaaagacagtaaattttatgtgtatgttttaccttaattttttttaaaagaataagttacttgcttaaagtcacatggctagttaatggcatgctcaagattggagctcagatctgtgtcttcagcccatcatcctctttcagaatagtcctggatgagaaattaggaagttcttctggatcataaggtcatacatgaataattgattcagttatcaaaagaggtctcagaatctcctgtttgggagacactgagtaatgagtactggtctagaatggtttagaaaggagatgagagccttgaggagatacaagggcattgatcaagtgacttctgggagctcctttcttattctatgactcaacagagtaagaaaataccatttttttgatagtttcaaattaggtagctcattttcaaagcagtggggagaaaaaaaagggaccctagaaacgaccatctagtaattcaatccctgttaatatagtggaacaaatattaagaggaataaaatactatctaggataatggaattatgagcaataagcattataggttttaaaagaacaaatcatgccagacaaagttgattgcttttttgatgagtagactaacggaatagagtagatgtaatacatcttgatttcagcaaaagattttatagtgtctcatgaaattttactcaggaaattaattgaaaatggcctagagatgagcactgttgcgtgaacttcggcatggtggcaggacagcagaagggaatgagaaacacccatgcatgagagtagggagacatggggcagggaatttcaggtcaagggttagttctatttaattatttcattacttctcaggaacaagaggaggttgatcttacgtaagtgaaattcatggtatatcttatctgtgtgctttaatgaaaaaaaaaatcatttgaaagctagcaagtctacgtaggttccaatcccaggcttaaactcattctgggtcccaggggaagccctgttgaagcaaacaatatcaagtaggccaatacttaatttcaactctaattctgaatgatgaagtgggtgtaatgttcttagccaagagctctgcctattcttgtgaccatgcccttgtcactgtgtcctatcctgcataggccccctttcaacctcaacacctgggagcccaccaagaactcacagcctggtacttaatgctataataagttatttagtacctgctatgttccaggccatggtaggcataaaggataaaggatgccataaatacataagacgtaaggatagttcatggtttggagtaggtgacagacacattaaacttgctgtgattattgctgtaatcaagtttaaacaatattttatgaaaaaaatacagtaggctcagagtaacatcagatagggaaaagcgggaggttaggagggtcaggggttgtggaagccagcctcaaagaggagcagaggccaggcatggtggttcacgcctgtattcccaacactttgggaggctgaggtgggtggattgcttgagtccaggagtttgagatcaacctggtcaacacggaaaaaccctgtctttacaaaaaatacaagaattatccaagcataatgtcacagctacttggggggtggaggcaggaggatcacttgagcccaggaggtcaaggctgcagtgagctataatggtgccactgcactccagtctgggtggcacagtgagagcaggtctcaaaaaaaaaaaaaaagaaaaaaagaaaaaaaaggatgtattttaccaggttctcaatggaaggctagatttttatataggatgggaaatgaaagggcaatgtagccagaggatagactggtgggcagccttggacaagttctgaacctccgtaagtgatatggaagactattatagtaatcatgtcagccctaagttgtgaggacgaagtgaaaggttgtctatatagaacatagcaccatgctgagcacagagtaaaggttcagtagttggaagccattatgctgtcactcctgatagtaggacctgggacaaggtggggtggagctgggttgcagcatgaggatggaaagataggtttagaaccagcttgtgaagaggactgtaaaagtcatattaagaaacccagactttattgggcagacaatagaaggacataaatatgggggtaacttgaccagcccttcttttgccaagattgctctgatagtgatggaagaagagtatgaggaaagggtagccacaagaagaccaggtaaggggctactcaagtgacagataaagacccaaacctactcccaaatggaagtgggagtacaaaaaggctgtgagtctgaggtctgttttggtaactaaagaaaagagaaccagtattaatttaattgtatagtttggacaactgggtatttagtaacgtcattatttttaaaacagagctcagaaacaacaaatttcaagtttggtttttcataatcccatgaaaaatttcttaagcagacttatgcaaatcaaccctctgaaccatggttggaatgccattttcatcattgccacttttgttgtagatgtgagattttagtgggctaagatcatctctcctggctctcagagacattggcaattggagcagagctgtttgtaggagaaatgtttcagaaggttttacctgggaagaactgggaaagctgtactaatcagaaagaggtaaatgaggaacccagaaaccaagggggttcctagaggtagtactttcctctctttttgccctctccttgtgttgtttcaacataacaaggaaaggtttttctaagtccccttcagggtggtttcatcatggagcaaaatgtttctttgttttgttacttgacatatagacaaacactagagagaagcattatacatatactgaccttaaacataataggttacagactagacctattagttataattttcctgcattgttacatggaacaaaatttaaactttcacaactactgatacccacagttagattttgtcctatctttttttttaaacattgaacaaaggagaatgaaaactagttgaaaatattgcctgattcattgtctgttatgagaagatattcaaatatgtcttagacacacaatacaactgtgagtcatccaaaatacagtctggttctcttgaaattatccccatgagattaaactctatagagggaaattgcttaaggatctcactgatgccatcactggttgtactctttcttgggtaaaagttggtgaaagaatccgggagagagagaaggaggacgatgggaaggaggaagggagggagagaaatcattctggaccaagaattttctttcaatcttttcctgtaaagctttgactgattacgtttactttgactcacctgaagtgattaataagagtgtgtctccataaaagaattttgggtctgtgtaatgaagacatttttacttaaacttttttcagtgtccctaagacataattactaggtcattttgaaatcatgttttatggttgctcaggaagatgaatatgaggagttccaatggggaaattaggcccgtggtttagtctgctctgatttatgaattgccctttaaggaaatacagtggtagttgaatataggcttatgggaagaccgtgttgtttaggaagtgtgttcagtggaaggagtattagcctaatagtcaaactgagctatgagtcaatttgtgactcagtctgatttattgtcaatcatcaaacagctcttgagtccctactatctactggacattcttctaggcctggagagcaatacatagcagtaaaagatatggtacttattctaaggagctcatatttttatcaaaaagataaggcacaaacatgtagcaagggttaaacatgatattataaaagcaggcacacaaatttctcttgggaggaagctgtctttatttggaaaaatgccttcacgtgtaggtcacagatgtccatatttacgcaaaaaaaacaatgagaggatatttctggaaagaagagaaggaaaagataggaccggtgaagtcaactttgacagtttcttaccagagggttgttgtaactgcaggagctggcataaccataaggagccagcacccctaatgatcaccttgaggttgtttatattcctcgatgtaaattctttctctgtatttattgcacctctcctacccaaatcttatagtgaacacacaaatggccttgcaataagtaaccttttggatgaaacttaaggaaggggccaaatttcacttttggggcaacttattataaaacatacaggaaattgggtcaaatgagacaattcatgaatctgaagttagaggtggccatgagcacctgggagtttgggaaatcttcatgagaattttagactttcacaaggtgcagaattggaggttcaaactcatcttccttagacctcaaagggcagggaggctggccccggtcaacttttagttacatatgtattaaaagatattgataggccgggcgtggtggctcatgcctgtaatcttagcactttgggaggccgaggtgggcagattgcctgagctcaggagttcaaaaccagtctgggcaacattgtgaaaccccgtccctgctaaaaatacaaacaaattagccaggcatggcagtgtacgcctgtagtaccagctactcgggaggctgaggcaggagaattgcttgaacctgggaggtaggggtttcagtgagctgagatgacaccgctgccctgcattccagcgacagagtgagattccatctcaaaaaaaacaacaacaataaaacaaaacagatattcataaaagacacagtatgatactccataaacatataagagttcaacagatagggcatttcttacattggcctctgttgggcctcagttttctgctatgccagctctaaatgacacagattggccattttagtaagtgtgtaagtggaggatagagtgaacacaaggaccagagtcagactgctcgagtacaaatcttggctccatatttatttactgtataatcttcagaaagtgactttatctctcaagtgtgccatgcaaatagacagtcataccttataggatttttatgagaatgatgtgattaatatatgacaggtcttagaacatcacctgttaagacctaaacaatcatgttatttttcttgttagagttcaaagtgattgcacacttacgtgtcctctcaacattgacataaactattcttatccgaatcatagaagtggaaatatcattcaatgaaaatgcaatgagccagatagtgtggtgagtcctggagttgacaatcatagcatcagtgcaaaatggcaatgcctctctcatctaatcttctggcctgttagaaagcccctaactaggtagagaggagaagcaggagggttagcatgatgcactggagacagtgaagtcagacccgtctgactctgcttcctgtagctgcatgacttccattgagatgcttaatttctctgaatcttggctttattacctttaaaataagaataataatatcttgttttagggttgtgatgagatttaaatgagtcaacatatataaaatccctagaagaatgcacaacactcagtaagtattggtgtcttcagtctctttccgtaactatgttacaaggagccagagaggagcagagtaagtgcttttaactgcccaggaagatgtccggtgtgagtacttcatgggagaagtcaaccaaatgagaagttgagggagcactacggtttccatgagggcattgtgtggtctccttcttctatgcctttatggctaatgcagtacttcaaggtagaattggggagggtcgtttaatcacattcaggaagagacataagttatgaaaatgcaaggaaactaagaagaccccaaaggaaagaaagctgtgagctttggaacagctgtgcacattccagctttccatggccccctgcctgtctgcttgcctctactcactcttctgaccacccctttttccccctttctcccctctccctgggccgtttctctcctcttttcctctccccaccttctcctggtttccctcatccccttttcaccctgacttcctcatatgtatctttccttcttttctttctcatcacaccccatctccaccactcccctcctttaaaaaagagggaattgtgtgaggcattggcctggggattggtggagttgagtgactggcatccaggggctggccttgtccccaccagtgatttcctcaagaggggccttgagagggagcagctgaacctcagcatatttgcccacctgtcttggcaactcttcttgtttccagttcctctgaacaaattgggcacagatcactcaggctttaaaacgttatctggtttgtgttcacagtcagtccacagtagagctgttactgcatttcctgggctaggatttaacatgaccagtcaagaagcgtgtctgtgggtgcagagtctgactgggccctgggcccaagaggaaccatgctggacagagggactgtggtggacagaaggaccgtgctggacagactcttggtgcccccattgtccatagcacatccatggcttatttggaaaggacaaggcttccttccaaaattgtacacattagagggctattttatttcatgtcccgaaagtggggtatcactttttaaaagatggagtctagctaataataattaaaaactggatatataagaaggggcatattagggtaaggtaaagggagaaacagcagagctgggaggggagagatgagagcaaaggagaaagttggaaagaaggtaaagtacagcagacaagaagagaaggaggcagggagagagggctcctctaagagattgatggtaataaatctcttttctttaaacattatccggtctgtagtattatgttataacaatacaagacagaataagacaatctgttgtgttgaagtagaccctcagaaatgcctggtctctggggacagatgttgcaaatgtaaagatgggttggtttatgtggtaggctggtagaactctttatttgtttaataactttggtccagccccagccctgagagaatggatgattcactttgcctccccaaatgtcagtccctgttgtataacgtagtgcttagaatgccctacgcttcttaaggggctgctcacagaaagtgtgtgaccaggttttgtgaccagttgagaacctggacagtgctgtcacaataaatagctcaccatggagaccctatgccatctccccagcccaccttccccaggcagaacagcccactcctgggtgtagtgatgtcagtggtatgcacttgccttcctggaagcctcacctactgatttaccatgggatcctaaatactgtctataaatgcaatgctaatttcattaagtagcattgttcccagtggaactgcaaatctccctatcagtcactaatgcttttgtttgagtgggtttagaggatccctatcactccttttaactacctgcagcaggcttgacagtgaatattagttctgggagaggcaggaggagaggaaacccacaattctagagcactggctaagcattaaatctaggactttaacatcatcatctctttaaggggaggggagggaggacaattctgaaagcccagtgagatacatgggtttgcttgagataatgagctctctcccaatttgattttttcgttttgctgaaaacttcataattttgaattaaatgcaagtgatttaaaaatcacagcacccaaacagtagcttaaactggctcaaagagggaattaaacttatggtccctgcttcagtgtagtttatgagcatcttggtctattctaggggtgagtatgtaataaatattatatatgtgtattacatattatgcagcacacataattcagaaaatttgtatcacttaatccactctagaaagtaaatatactagcattaatatgtatgctaaataaaatggcactcgtcacacttgcatattacacatctttagaaatcatgctagtattttctgaagccaggtcaactctgtgtgggtgttttatttgagcacttttgcagcccttgctctcccatccctgaataagggttacacctagccactgctgtcttcctggaagtgttgtttggtggtatttggcaagtagttgacatgtctccaagaaaagatatatttattaactcaaatttcataatgctagaaaggataccaaatgaacatctttccatgcaggtagttagttcaggtgaggtaagagaagcccagctttccatgcaggtagttagttcaggtgaggtaagagaagcccagagaggttaaggcaccttaccatagctccaagctgatcagtgagagaggaggccctagagcctgggctaggacttctgcaggctgacatagtgctcattgtaccatattacactgctctcatttgagtgctacacaaaggcagaaaaaaactcattttaagcattttcatttcctttgtttcccatggaattacaatcctttggcctggcttgagtggacagtggacaggagaggagcagatgaacactggaagctcacgttttttcagccttgtagttagctctcccttctcctcccggaacaggacacatgcatggcccgcagagacacccaccatccctccagctgttcagttgagtgagacagatgctcagtccagcaagtgacccaaagtgactggcaaaaattaattaacttgctgtggaactaataataagctgctggtttgttttttctttccctaacaccagttgccaaagagtttttcattaaggggctgaatgcttcctttgtaaccagaataacctcattagttacagccccatcgtagctggagagtcagacaacaaatcattgtctcctctttagccaccgtgacctaacttgttgtctttcattgtctttcttggaggagtttctgtccaccccaaacattctccatcccttcttcaaggtctctttcagaagtgactttcaagtgtatctacccactgtgtttttcttgacagcagagccattttgtgtttgttaattcaggcctttgttggaaagagaataaacatgatcactctatgtccatatcccccaattccctagcttctttacccaggcacctttggttggtgctctgccattttaattcatattgcacggtgctttacaatgtgtacctcagtttcagagacatctttagtcttaacaaggacccttctatgctgtccccattttacagatgagctcgtggaggttcagagaagtagcatattcggagtcatgcttctactgaaagacacaaatggtattaagatcaggacttctgactctgagtcaagtggtctttctaatccacaacagctgcctctcagtcccttcttttccaatgttatctttacagtccaggttttgcttcccttctcactcttgtccaccttagccttgttactcctttaagacttttgtgtccaactaattagcttaaagccaccaagaagtgggtggcagggcaagggcactggatcacaaaagatccacctattggttcatcctccttgcaacttcaccaatcttacttcaagctggcagcttacctgaactgatgccgttttctatgttaaatattttgcatgggtgctttctaggaggaaaaagtgaggaagcagaagagggagacaccatgccctttatataagcaggaaaaaaggttctgagttttgttctttgaacagttttttttccctgcaaaaagggatggagtagtaggatggagaatgaggagcaaggataaagaagtctgtgatgggagcttcaaacgccatgtctacctctctgtggagtacataaggtttgatccctccttgctcattggattctgagtctctccacaaagagtgcactacctggctttaagtcctggctttaccactcacttgctgtttgactgtgaacaggacatctaacttctttgtgtttcaggttccttgtgtgtaaaatggagacaataatagtttcagtttcatagggttgttatatcaaataaactaatacatgtatgtcacatagaaatgcctgtgcattgtaactattcaatgaatattagctagcactattaccttagctaggaattgagatattagcatttgctttcaatatgttcccctgcctgtgggaagaaatatgtatacattagttggccaggtttaaatacatgcttacagtctcagtcattagtgtcctgtgggatagaaatgtaaagtgcttcagttgagatactttaaaattattcatagaatattagagttaggacggatcttacatatcattcagtcagtccctctaccattccaataaggccatgaaagctgggctttatcatagacttttgtctttaagaacttagtatgtgtgttgggggtggggttaatgaagtatttaatgtaaaaatttacatttttaaaattcaccctttgtagtgtacagtcccatgaattttgataaacacacacagccctgcaatcaaggaaaaaaaatttccatcaccaaaaaaatgttctagtgtctcctctgtttatttaaacttgtatatatacatatgcttgtgaccctcagacagaatgataccttcttagagaaagatgtttgtggatataaatatggacacaggcatttagtagcacagcagctcttctcctatgacccagtctccagctagcatgaccatatgtcaatcagcagagaaatgcatgaagtatgaagtcacttgatatttgacctggattcgttccaagttgcttaaacacaatccttcagaaaagagaaacacatctttatactttattttccattttctttctatgaagagtatctagaacttctataattgttcaaaggcaatccatgtttgtgagctgattttttaaatgagcctgatctctgaaatgagctgagaccttacaactccaaggtgatgagtgttagagtccagagatcatgggcctaagccccagaggactgtcatcttgccctgtgttgttatgagtgagcttttccaggcctccctggactcagctcagaataatctgagggaggactgaatgcgttcctcatgcactctgttgttagtgaaacctcagtgttagtgtgggaccccgtaagatactatcttcagcatttttttcttttacccccaaaaaatggcttggaaaaggtaacatacagaactggtgtattattatttgctatttatttggacatcttgacatcttcccaaaattataaagcacaaaaccattaattaggttcacaaaaggtgcacttccctgtttctctagatccttagtttgttaatgtcaccatattcagcccctaccagcatttttataataccccagtattgccaagtttccacctacaggaacttcctgagtctaatccaaagaaccttcttagactttgaaggttgataaatcagagacagacatggcttattcttgtttttgcactttcctattagtatttttggacatttctctgatttatattcctggaaaccaatatctggtcttcagcagctcagatactttcagcttttgaagatgtcttcagttggtagaacaaaagaacttgttttcttagcctacagtaagcgaacaatgacagaagcagccagttcgtcatcttttctttattaacagatgtcaaagtaattgatgagggcttttttttcaacctttagtatattttttaaatggattgattctggggcatctcagttcatttactgacagtgtcttaaggaggggaatgtggctgtaatcaattttcattatcattgtgtagctaataagcctaaaaataagaactcttaatttgctatggcatgattgattacccaagaagaatatggaaataacatctttcaatatgcctggagagttacattagacctctaaaatttccatcttcaaaacatatcacttcctataattttctatccactaataaaataactcaggactcataacatcacttttctctgggtcctaacctcaaagggtgatctccagttgcaattttcatattcagtgttcccctacccacaaactgtatgacccaagcttcctttttcatggattctttccatcattgtttctctcaaaataattactggaaggcatgctagacctggaagacccaaagcagcttcctggagcactgactgtttgtataactctccctagaacaaaaggaggtcatctggagcatgacagccatcacggagtctccaagatggtgtggtaaagacagaaagctgaagatcatatactcttatgagcaaaccactgggctgggaataaggagaacttgggtccaagtgccaactctgtttcatccttttggccaactcttttaatcttttagacctgttttctcgtctgaaaaatgaatactaaatcccatcctatctcacagggctgttggactatgccagtgacataatgtgtataaattcactttttaaccacacaattctgtatattattattattgttgttactgcaacagagtcttgctctgtcacccaggctggagtgcagtggtgccatctcagctcaccgcaacctcccttcctgggttcaaatgattctcatgcctcagcctcctgagtagctgggattacaggcatgtgccctgcccagctgatttttgtatttttagtagggatagggttttgccatgttggacaggctggtcttgaactcctgatctcaagtgatcctcctgccttggcctcccaaagtgctggaattgcaggtatgagccactgtgcccagtcctgtatatgatttttactactttttctcatcttctctatctccctattttgaatcacctcttcctcataccgtgtatcttctcccattcctttaccttctgataaaactttagccaccctttgctcctgcctgacatttattgagcatccaatccatatctggtcctttgggatatgttgggacatttaatctttacagtaacttggtagagtacttattgccatgacccttttacagacaaagaaactaacgttcaaattaagttaagttaggtaagcaagaggcaaagtcatgatttcaacggaagacgatccaaccctaggtcacagtttctcagtgaggagcttctcgagtctaattcttggtctggtcaaattaaaagacaagatgtgatgtacctaaagacagggcgaagggagaaggagttggggaaagtcccaggtggataaactggtggctttttccctctttagcatcaatatttcttgtggtttttaaactatccaggtgagggtggaaaaaaacacagattgggtttctcagctctcacgccaaaagtcaacacagatagaagacatctgtgaccacatgtatggagattttccccgcacaccaagcaagcaggaagttctgcagcaaacaccagctgggtatcctccagttcagttctattctgacactatctacctggagacagcgtcagactccactggttgagggatcagtccccaaaatgcccctgcttcctaccagtcttaagtccaagccttaggaacctctgcctgaccagcttcaagttggggttctcaccattgccactttgggtttgattaatttgctagagcagctcacagaactcagagaaacttacttatgtctaccgatttattataaaggatattacaaagaatatagatgacaagatgtgtagggcaaggtatggggaaggggtgtggtgctcccatgccctctctgggtgtgacacctccaggaagttccagatgttcagctacccacaagctctctgaaccctgttctttggagtttttatggaaacatcattacctaagcgtgattgattacattattgaccattggtgatcaacttaaccttcagccactttgtccttccctgaggctgagggatgggactgaaagtccctatcttctaatcctgccttggtctttccagtgaccaaatcccatcctgaagctacctaggggctgccagtcatcagtcaatcattagcatacaaaaatgcatcactttggaatttttaaggattttaggaattgaatgccaagaaatgggatcgaaaatgaaacatatttcacaatatcacaccaagaaactttcattatggaaaagcatggctcttaatggatgcttcagcattcttccctttgagtttaaatcacatcatgcaaagagaactcgttactccttcattaaccaagctcaatcattttttatttcactatgggcagcagaccctaagccaggggttcccaatctgaagactataatgcctggggagttatgataaggaatccagaaatttatctgtggactaaaaagataaaatggctgacatctctaggtgctattttaaaaaaatatagatgaaatagtgaataataaaatagaaatttgtttaagagcatcactaaattcacaggacagtagaagctctcttaattaaccttccctttaccagctctctgtattagctttccctctgtaaagtatcatttttttaaaaattcccagaactgagcagaacactctgtaaattatcttgattgatgcccatagcatcctgtacactcgaggcctataggctgttcccttgcatacatgcacacttctgctcaccagttaagatgctcacttcccaagaggctattgtatttgttctaaaagatatttatggtaattataagattcaattgcaatgcaaggagagagctattgtttctatgaaaactcagttgaatgctgcagaaagattcaataaaggcaagccagtacaaaagaagttgctgctggatgaggcaggacccctgagaacgactctcaagttgtcactacacgactccaagggataccctgtggctgacgcctcctcgagttgtgcagggcataactgcaaaacagcacacagaagcctttgaattgggtgactctcagagtttggaaagaaaaacataaatatctctgagaagatgctattgaaaatgatcctcagatctttttaggttcttattccccatcacataaacccaaactgaaaattataaccaatgcattaagggtctgataaatgtgagaaagatgctacgcagaagacattgaccttggacatgaccctctatcaagagattggtgtatgaatatgtgtgtgtgtgttagttaaaacagaatgtttaaggtatcataatttatggttctcttacttaactagctctttaaattaacatttgtatcactactccttagggattccagcctttgcttgttttacacgttcccaaccagcttgaagcgcagcccccactatcatgtcaggaagagtggtctggatgtgagaagctttgaagttacagaggagatctctttagtggcactcagatagctcttaactgagaacagggttgggtaattccatcattgtcatagagggggctgagatttctgcaaacacccatatcggcttctgtgtctgccacacactccctgaacatcccacaccactgttgtttcaagaactccaagtcaccgtgcggcgactagcagactctgcattctccataattacacccaattttccaattgaattatcgcatgatttaattcgtttggtgcatctggagagcatcagcattgtgcagctgttgcagcttcaagagctaattgttaccaagcacattaaaagtagccctattgcaatgctctgaagtcagaggggagggggcacacactttcacttgccattttccctttggttgaatcatcacccaaagagcctgagggggtagcaaacatttaagctctgttaacacggagacctcatcgggtatggttactgtcactggatgaaacttcttaagtgagtcagacatatccagataccagaaaacagagaaacctgaaagctctgtttggcatgtcttagagaatcatgccaaataagattaggttagaaactaaaggcagtgttaaaggagagacagtgcttcatcaaaaagtactaggaagtcgattgttaaggaagccccgggacgtcttaagaccccaaatcttacttctagtaataagccaccttaaagagagttacccttttccataatgaaagtttcttgatgtgatattgtgaaatatgtttagttttttaatcccatttcttggctttcaaatcctaaaatccttagaaattccaaagtgatgcatttttgcatgctaatgattgactactgactggcagcccctacctggcttcaggatggggtctggtcactggaaagaccaatacagaattagaagattaggacttttatagctgctaacctatccatatgttcagttcatcttgatatgtttcattagagaatctattttgtatataaccatttgaaggcttgcttcagtgtaaaatactccctaatattcatctgcaatctcttgttacttagggtcttagagtcaggggtctgaaactctggaaggcatgggttggacacttttccttccttcccttccttgtggttttaaggatgtggagtttgattcccaaagggtctctgtcctctgcatagattttgtggtctatacatatgctttcttatgtgaaagataaaaatcatgagttcatgaaaagatattagggttatcatatctgagctgagggctagccagggaggaaagcaggccatggggggccaaagtaagggctggagggcagaggtgagtcaactgaaggagagaatagagggaccctaaatggaatataaggacagagtccacaagccaggcagaggtgagagcatgggtgcaccataccaaccaccaggaggttgaggaagagtctgtatcctgaacagtgagatgtcctagcctgctcctctttcagacttcagaacagtgtagttagttgaatgcccccctactaaggaaaaaaagggggttattcctcaaggagactggcatgccccagagaaaaatctgttattgccatggggaatcattcaatggttcattcctggcccaatcaccctcctatgaagtttacaaggcaacagccctcattcatgtgcatagaaattccaattggctttgaatttttcataaagaacaaccaaggatcaacagatatttgatgatagcagttctaacagaaagcacagtgactgaaaccaaaacgcaaattaaaacaaaggtcggtggtgaggtggggtgagggtctcagagtcaatacggggagcaggaataaatatgaaacacacactctgtcacacacacacacacgcacgcactttctctctctctctctctctctctctcacatacacacactctctctcacacacacacattgtaacctcagaaagtgtccagcataattgaatcccacactataaaaggcatacacaatatcatataattataaaacttcagagtaatagaaaataaagattgtatgtcttgcaaaggaaaaaatatagatcgtatacaaatgatggggaatcagagtagcatctgcattaacatctgcaatttggggacctagaagtcagttgataaatgtgttcaaaatgtgaatggaaaataatttccaatttagaattccatacccagccaaactatcattaaatgtgaagttaaaataaagattttttttacacatgcaaagtctcaaaatatgtgcttgttgtgcatccttacttaaaaagttactgaaggatatgccacatcaaaataagagaataaaacaaagaataggaaaacatgggatccagaagacagaggatccatttcagaagagaggaaaagagaattcctagcataatgtcaaaagaaagtagtggagtgaattgaaagtgttacatgctaccacatgagtgaggcttgaaataatgatgctaaatgaaatcagccagtcacaaaaggacaaatactgtatgattccacttatatgaggtacctagagtagtcaaattcacagagacagacagtagaatgatgattgccagagactaggggaatgagggagtggggagtgaattggtgtttaatgagcacagagtttcaggtttacaaggtgaaaagagttctgaagatgggtggtggtaatggttgcacaggactgtgaatgtacttaataccaccaaactatatacttaaaaatgagtaaaatggtaaattttatgttatgtatatttcaccacaattttttaaaaaaagaaagtgtatgctctaggaagggagaattaggagggaggggcagctgtgttttgttgtaagcctagagtactaactgatttttcaaattatttatgcgtaatacttcaataaaaattaaaaaatgtttaaacctaaaactaaattggggtaggcattccaggccaagggaactgcatgagcaaagtcaatgaggtgcaaaacagcgtgcagagaactttaagaattttcttcttcatggagagggttgaacacattgggtaaaggagctgcagctttattctctaggcagtgtttccctacagtgtggagcacacttacagatgaacatgataactttgtcatccaaatccctacatatttaattttaatattatcttctattcataatgaatgacacattgggttttagtttatggtgatgacaataatgatttagattccctaaactgaatctaagtttataaatatgagttggttttaagaaaaacattaggtgaataatagagaggcatgtgactgtggcaaaaaaaaaaaaaaaaaaagaaaaaatcatgaacgtggtgcatggattactatggtagatgaaacacttctctgagcaataggaagcccttgacggtttgtgtgaaaaggggcattcaagctaagtgtatggacgggcttaatcaggggaatatgaacttcattctacagctccctcaattccggacgcttcttcacaggctgccttgaggtgggatgaaagagagagcttcaaatagagatgctctgttctatatatgagtctacctataattacaaaggagtggccactaaacatgaaagattgcaggccactgagatagatcattctggttaggtgggaattaggggagaaagactaagaatggggaagtcaactgagaagctgatgcaagtgacctaacaggagactatgtgggcctggcccaggacagtatgcagggagaagaagagacatattagagatgcagagctcctaactgaatgcccagagttctacctagtggcagctcatctgaactataagtatagcacttaaggagagatacacaactcttagagaacaagccttacatgccacaatacagaagtgatggcagaagttcattgccgtattgaattttctaacgtaacttccattactaggagcagttgtattcaaaactgattttgccaagcccagaagaatgtgaaactggaagaagagccatatattatattacaaggaaactagacttggattcatccattcattcatccattcattcaccccacaattatttgttcaacacacattgattcaatacaacagtgcaaggaactggtttatacacacagacccatcagtgaacccaatcaacatcaatccctgctttcttgatccttttacactcataggaagaaataggaaaaataagcaaaatgtacaatatgttgaaagtaaataagtgctataaaggacaataaagcaaggaaggcaggagtggtgtggtgcaatttttgaaagggtggtcaggaaagctttgtgtgacagagaaatttgaacaaagaattgaaggaggtcagataatgagccacacagccatcttgcgagggccgaccaggcagagggagtaatgaccacaagggccctgaagcaggagaatgcctggaatattcagggatggcaagacgaccatgtggctagagcagagtaaggcaggaggagagtggcaggagatgaggtcaaagaggcttcagggcaggctgtaagcgtcttggaaacatcataaggactttggcttatactcttagagaaatggaaggttttggagggtttggagcaaagggaaaacatgttctaatgcaagttttaaaaggaccccttcagctgtcaagttgagactatagtgaaacaagggctgaagcatgtagatgtgtagaaatattttcaagaaactaagcaagaaaaagacaacttgtatcagatgctggaagggcagatggtaaggagtggtgtttttgaggcggagccaatgacttggacatagaatgtgagagaaagagaggaaacaagagtgacttcaatggttttggcctgggggggataaagttgcaattaattggggttagaaatgactacaggtagatcaagtttgtgtcagtgactcatgaatttaggttctaatgtgggaaactggaatcattcaatccataacaatggccaagtggagatcttaagaaggaagagagataaagggccctggatctcagggcagtggtctcggctgaagatacaaatccagggtcttcactggggagttgttcactagggagatgagactgaaggagatttcccaagggaatgaatgactgtagctaagaaagagtagaagaccaaaggctggtccccatggaactccaatattagcatcttggggagatgagaaggaactagtaaatgtgattaaagaaaggatgatgaggtaggaggaaaaccaagagagccctgtgtcccagaagtcaggtgaaggaagtgtgggtgtgggagtgaccagctgtgggtgaatgctgtctatggccaaggaagagcatctgagggctgagggttgaccactggatggaacaacacactccttgataggagcagtggtggcacaggatggcggaaaaagcctggctggagaaggaattgctgggccctggtccattccaccaagtcaccatgcaacttctctagggccagtcttctcatttgtaaagcgaaaaagctcctactagctctaaaattctaagattttatgatgattctaatggagtacgctttattcttttcatgaaaatgataccatgagagtatttggaatctgagaaaaatgtgggtgaaaatgcgggacattcctcaagctgaccattgggtcttatatgaaagaagccaagtttgtttcctgttgaaaacaactgaatacacactttctgacttttcccacaaggaaagacacctcatttatatttgtatttttggttttgttccgtgtgtaatattgatcctatttaattaagatttccagactctcattaaacagagtttattttgataatttcccaaaactgagcctttacactttgataactccacctttctcatagatgcacttacccactaccacctggtggtagcaaaaatattacaaaagagaagaaaagaggagaaagtaaaggctcttatttttagtttactaggctcaaggattggacctggatctttctgggcagtcttggctttgggacatctccaaggcctccaagactgtgggacctggaggaccctatggagaattgacattgggtgcttggcctggagtccttgcacccagagccagtgaaatctaaacacactgaatatttatgagatattcctaggggaatgaaccaagcaagtcaggatcattataattaattctgattttctgaaactacttgaaatttctatttaaggaatgatccatgcatgaattgtttttaaaacttacctttttaatacgtacttttagaaatttgtttctagtaaaggttgagctttttgtttttttttaaggtcttccatctgtgtcggagacaaactgagcatatctggttgctaggggtataaacttctataaatgatcagcaagcataatggctagcaatttgattcctacatgaatggagaagttgctgctttccctggagagtggggggaaaaaaaaaccttaatttgaaaagatatataggctttattctgctcttgcaaagacacacagacatgactgtaatctctctgtgtttctgaaaccacagggaaagctagaagcagctctaggtgaaaaatactgaaggatagcaggaaactactagatttctttcctttttttttttaaatatactttaagttttagggtacatgtgcacaacgtgcaggtttgttacatatgtaaacatgtgccatgttggtgtgctgtacccattaactcatcatttaactttaggtatatctcctaaagctatccctcccccctccccccaccccgcaacaggccccagtgtgtgatgttccccttcctgtgtccatgtgttctcattgttcaattcccacctatgagtgagaatatgcggtgtttggttttttgtccttgcgatagtttgctgagaatgatggtttccagcttcatccatgtccctacaaaggacgtgaactcatcattttttatggctgcatagtattccatggtgtatatgtgccacattttcttaatccagtctatcattgttggacatttaggttggttccaagtctttgctgttgtgaatagtgccacaataaacatacgtgtgcatgtgtctttatagcagcatgttttgtaatccctcaggtatatacccagtaatgggatggctgggtcaaatggtattcctagttctagatccctgaggaattgccacactgacttccacaatggttgaactagtttaccgtcccaccaacagtgtaaaagtgttcctgtttctccacatcctctccatcacctgttgggaaactactagatttcgattgttatagtatgcccatttcctcccctccctaacctgattgatctgagccagctcaggaaagagggtctaagttataagacagagccacagttataaatggcctccccactgttcacccgctcctggctcaggtcctcattgccctccaccaagccttttgcaatgcccatcctctaggttttcagtgtccaattctcttagccagcattttcctccaaagactcaggcttggctttgtcactcctctatttagaaagttattggttgctcctattgctttagaataaagatcaaatttcttagactaaaattaaaaactctccacaatctttccaacatattttttgaattacttgtcttcatgcaggggccactcaagtcaactttgttatgttcagatgtccacacactatatgtggtaaccagtttgcctttgcagatgccattccctttcctggtgatgtatcttgcttcccagtaccagccctggaaactttaatacctgcccatatcattttaacttttcaatgcatatttcaaacccaccatgacccccaagaaaccattattatttttccccagccaaaaagattatcttctttggctttcccccataccattttatctctttggctttcccccataccattttatctctgtctcttttaaatcttcacttcttactttctattaggtgttattattattcctaaattttaaatctctaataaactctgagctcccagaggaaagaggcaggttggatttaatctcacatagtatgatacttggggtaccaaactatgtaggtgctaaataaaagttggtggaataaatgactaaatgatagttactgaaacaattcctgaagacagtaggcaaactgagtttaaattcaagtagagaagtaaatatggaaagagattgggatttatccatgtagtactaatggaagaaattataacaggttttttgttgttgttgcttattttgatttgcctgtttttctttttttaaagaagagctgaataggtgagagttgagtctgagacaggagagaaactgcagaacacagctcaggatgagaaggacccagtgaaaaaggaagctgaaagagaggaggatatttaatgcccctgagaagaaatttatgccgacccagatttgaagtcaacctctgattatctactatttatatattttaaagaaatatgcaggagattttagtgcttccttttttgtttgtctctcaatatatgcatgagccagcacaattcaggacttgatttacctttgctgattcggcttcttttctctgagcttatttatggctgtgagagaggcattctgtccttgctgataaaggacaaccgaattgcattcaaagctcagccactgagttgctttgcttctgctagaaagttggtttcttctccaatggccaagttttcctgaactataggaaataaggtgcatatttgaaaggtagagtcctagactagaacttctcaaattttaatgttcctccaaatcttccaggactcttgttgaaagagtaaattctacttcagcagttctggggtggggctgagagtctatatgtctgacaagctcccaggtggaccacactgcaaagcagtgtcctagacttttgaagacagaaggaacttgagaggtcatccaagcaagtggttcaaaatacaaattctcaggctccacatacaaagaatcatggatggagcccaaagaggtgaatttttgataagtttcctagctcattcttatgtatacctgggtttggaaaccacaaattagtctgatcccccattagggatagcaaaactgaggcccagagactaattgaattccatgaagaaaagtttctgtttatatgaaaggggctttcctgaaaggataacccttatacattttgctgccctaagtgaaggttcccctttaaagccacagaaataactagatcatctatataatttatttcttaaaagctactagcagagaaaagcaattttttctgcctcttttagaatgacaaatactctaagttattttagttttgtgctaatagtagggggtggtggtggtggtggtaaggaatggctattaagcaattatgttattcaaacacatcattattattattaccaagatgagtggactcattataattgaacaataaaagcatgaatgactttgcattgttattagtgtctgtctcagggcccctgtttttcccaggggctgttcagcagatccaactcacaatgtactggacttgcggtggttcacttgcaggcaattggattgttttttcagaatcacgcgctgtggtcatcttttcttttctggtactgacctactgttcattcaagactcttgccgcccccacctcctgctcagaaaacctaatccttgaaagactgtggcctccctgactccactcttgtcaccttcctatccttttttttcacacagcagctagtgatcatcagaactgtgaactggcattaaaattcccttgcttgaaacctgccaatatctgcctatttattttaggataaaacacaaatccttggcaaagctttccaggcccttaatgaagtgtgccacttccttcagcagccccactgggagctgttcctcttcttcccctcaccatcactgcccccgccaagcactatactgttttcagcttctggaatgtcccgacatctccagtttctggaatattctaacacctctctgacttaggggatttgtacatgctcttctttctattcataatactctttccctagctgtttagttcttatccttaagatttcagcttaaatgtctatttctccttcactacctgactaattcaacaccccatatggaccccttccataatcctggcacttcaccattggtagcggtgtctacaccagtaattacttgcttaatgtatttcttcccccactaatagtaagccccaaaaggacataactgtcctttcgagactaactccatattgttcaacacatacctggtatattaggccatcttcacattgttctaaagaaatacctaagactggataatttataagaaaagaggtttaatggctcacggttctgcaggctgtacaggaatgtggcctgtccagcttctcatgtataggcatgtacagaatgtggcgcctgctcagcttctttcctcaggaaacttacaatcatggcagaaggcagaggggaagcaggcacatcacttggccagagcagaagcaagagacagatcgtaggaagtaggtgtcacacacttttaaacaaccagagctcatgagaactcactcaccctcatgcggacagtgccatgggaccggtgccaaaccactcatgagaattccacccccatgatccagtcccttccccaccaagccccacctccaacattggcgattactgttcaatgtgagatttaactggggacaaatatacaaactgtatcacccggcacatagtaaatgcttaatagttacttactgaggagatgaatgtttgagaatccaccaggtactgaaattgcaatagagaatcatggagacagaagggggaactggaggcactggacctccctctgtctaattcgcagcattaggtgctgagcttcttcttctgtagttgcatctcccctacccctccaccatatgtttaaaaaagtttaagtgattaaaatatgttttatccctaagttgaacgtcaagacccagcacatttgatctaggtttcctagaactgtggtggcattgttactctgggaggatatgtggatgaaatcatgcaaaccctggacctgaactttcataggatgttgtcgaagatgctgttcacgacagcactccctgttccctatgtaaagacacacctaagaaatgtctcttgtagatttaaatgtcaggaagacctttgcttccttgaaaaactgctgagtgtttgccttatgttcactgaattcgtgaaccatgtttttctctcttagctttgactgccagaaagctcagagtcacattctctgctcaatttttgtaactgtagaagcctatagctcgcacacctggcaatgtaactttgccctagtcttgatttcctattctataaatatattctccccggtctcagtttattaaattatttgtagctttttattttagagtgcaaagtcttgtaagtttgctcaaatccttagtggaatgtggcaaggagatatatgaaagaaagaaatgcatgaggttctgagatacattccgtttaacttgcagagggttcctatctgtgggtggtcctggcaggggcagtgcacagaaggagccctgctgacatgggtgtctgtgcaccacgcaaggacacagcagggtttctagaagaggaaccctctggaacagcttacggaggtggttttgttcctgatctcctgccgaagctaccctcaggtgacccagaagtgtgagtgatgccgacctccatgcaagatccgaatccttttctggggagtggctaaatatgagccctgtaacctgtcctgaaattctgtgtgaaagctagatttctgctggcatgaggtcttctactataaggtcagaattagagtgttttcttagctaagactataatttcagctactttctaattctccttacgtgcccagtattgctgtagaagccctatttgttttcaataaagctggcatttatttcttgtctaagagagcaggagcaaccatgtggtccacatgtactgaacacgggatgccatgcatgtccctcacacaggctgatttgtgaaggagcctcattctctgcattttgtatatgggtaaaacatgtataaacatgtatatggctcagggagagagatttgtcagaggtcactagctaatgagagggggtgctgtggttcagtcccagtcttctgatcccaaataggcagatcctctacagcccatttcagatggtgttagaacagagaaactgtagggcaagaaacaggccactccatgggtgagataaggagctgttccatgtgaagctgggaaaggactaacaggcaggcagaagagaaaggacgagacccttgcaaggattcagccacatccttggtgtacatgcccctgccccagcattatccgcatccatctccccccacccccaccctactccatcatccttgccctgtggtcattgccacaaacaagttccctgacactcgaagctgtcctggctgtcatcattcttgtctccccaaacaaaatgaagattgcttgagtggagagctttcatccacagccttgttagggtaggaggagctcttggaaggtgtatactagtcaatgaaggtttatattggcaaaaagttactatgtgttgatgtacagtcatgttctgtgcccctaggcacagacttcacaataacttggtgtggtagacaccattacctttctatattgcaggtccccatggtcatgcagttagcaggtgctggtgtcccagcttcctgcctccgctttccgccattgttgagatgccaaaaatggctatcagagccctccaagtatctcaagtttaaggtgtgctttagggaaaacggagtcaatagagaagaacatattccacagccctctaaaaagctctgatctgaacactagagctctgcttatttcattgacatatacattgatttttttttcaagtttatttcaaaattctgtatcgggtttaattaccagcttgagttttaatagcaactatatatgttttaattaaacttattatgttgaaagaattatggattcatatacagttataaaataatatagatttcatttccctttttacacaatttccactaacagtaatatcttgaaaacataagtgtgatatcacaaccatgatattgacattgacagagttaaggtacagaacattcccagcaccacaaagagtcctctttttttttttttggagacggagtcttgctctgtcacccaggctggagtgcggcggtgcaatgtcggctcactgcaacctccacctcgtgggttcaagcagttatcctacctcagcctcccaagtagttggtattacaggcctataccaccacgcccggctaattttgtattttttagtagagaagggatttcaccatgttggccaggctggcctcgaactcccaacctcaaatgatccacccgcctgttgcttttttatattctcatccacttccctcctctctcatcacttccttaacccctggaaactactaatctcttctccatttctacacttttgtaagtttaaacatgctatacaaatggagtcgtaaggcataaaacctgttgaacttggcttttcttactcaccatacattttctggagatgtatctaagttttcacacgtatgaataatttttttcttttattgctgagtgatattccatggtatggaggtaccacagtttgtttaatcatacatccatggaggaacatgttggtttctagtttgggaccattatgaataaaattgctctaaatatttgtgtacagatttttgtgtgaacatgtcttcatttctctggaatacattttcaggagagcaaccactgagtcctgtggtaatggcatgtttacttttataagaaactgccaaactgtcttccagagtggctgtaccatgttactctcatcagcaatgtaggagtgatgtagtttctctgaatccttatcagtatttggtgttgtcattttttattgtagccattctgacagatgtgaggtgatagctcagtgtggttgtaatttgcgttttcctaatagttaatgatatttaacatctttcgtgtgcttattttccagctgtttatcctttttgatacaatgtgcctttaaatcttttgcctgttttctaatttgaatatttttaattgttgaattttgaggtttttaaatattctagatactagtcttttctcagaagtgtggtttgtaaatattttctcccagtctgcagcttatcttttcatcctataaacaggatctttttgcagagcaaaagtttttaattttgatgaaatctaatttaccaaatttttcttttatagatagtgttttttggtgccaagtctaagaactctttctgttgccctacttcctcaaaattttatcctatttttttaaagtgttataattttacatcttacatttaagtccatgattcattttgagttagcttttattaactaaaaattctgacctaaggtcatttgtttcttctccatttttctttatctttcttttcttttcttttcttttcttttcttttcttttcttttctttctttctttatttttggcctctggatgtccaattgctccaagaccatttattatttgttgcaagcctatccttcctctattgagctgtttttgtacctttatcaagaatatgggcatatttgtatgtgtctgtttctgtgttctcatttcattccattgatctatgtgtatattcctcccccaacaccacatgtcttgattactgtagctatatagtatcttgaattcaggtaaagcaattcttcccactttattcttctttttcagaagtattttagctattctagttcctttttcacaagaatcttcctgggattctgataggaattgtgctaaaccttgtattagtttcgtgtggccgctgtaacaaatgaccacaagcttggtcatttaaaacaatagaaatgtggctggacacagtgactcatgcctgtaatcccagcactttcggaggtcgaggtgggtggattacttgaggtcaggagttcgtgaccagtctggccaacatgatagaaccctcacatgtaccctagaacttaaagtataattaaaaaaaaaaaatacaaaaattatccaggcatggtggtgcatatttgtaatcccagctactcgggagtctgaggcatgagaatcacttgaacctgggaggcggaggttgcagtgagccgagatcacacctgggggacagagtgagactctgtctcaaaaaataaaataaaataaaacaatagaaatgtattatccagagttctaaaggccagaaattaaaaatcaaagtgtcagcagagccattctccctcaagaggctctcggggagaattctttccttgcctcttccagcttctggtagctgctgacatcccttggccacatcactccaatctctgcctgtctttacatcataatctctgcataatatctgtacaattgtcaactgcctctctcttgtaaggacacttgtgattgaatgtagggctcacctggatcatctaggttaatacccccttgtcaagatctttaatttaaccatatctgtgaagaccacatttccttataaggcaatatttagtttagaacctgttatctttgggtggttattattcatcctgttacaaacctatatatctattttggggaaattgacaactttactatattaagacttccaatccatgaacttagtattctttccatttatgtagctcttctttgatttgcatcatcagcatttagtagttttcagcacacaaattctgtaccggttttgttagatttaagcctaagtgttattttttgagtaattacaaatgttattgtattcctaattttgatgcctgggtgttcattgctagtatagagaaatacaattgatttttgtatattgaccttgaatcctgcagccttgctgaattcacttattagttgtaggagtattttgattaatcatatattttctatacagacaactatgccctctgaaaatagggacagttttatttattcctttctgatatatatgtcttttatttctgtttctttgtttgttatttatgtatttttgccctattgccctgactataacttccagtactatattgaatagcagtcgttagtgtggacatcttgctttaaatctcagaaggaaagtagtcagtcttttactattatatacagtgttagctatagagtttaatttgtagatttatcaagttgaagaagttcctctctccctatctacttttctgggttttaatcatgaatgagtgttgaatttatctattgctttttcttcatgaattgatattatcatgtgatttatcttctttagcttgtcaatatggtacattatattgattgatttttttaatattgaaccagccttgcatccctgaaatagctcccagttaatcatggtatataattctttttatattgctcaactctgttgggcaatattttgttaaagatgtttgcatctatattcagtagggatattgatttggagttttgcttttgttttgtactgtctctgtttgattttggttttggagtaatactagcttcataaaatgaattggaaaccagcaccgcagtgtgtcactaatcctagctattcgagagggtgaggcaggagaatcacttgaaccgggaggcagagggtgcagtgagctgagattgcaccactgcactccagcctgggtgacagagcgaaaaaaaaaaatgtgcaccagtcatcctttcatgaatagccaggacacctggacaacatagtgagactctttctctaaaatatatataaatgaaatggaaattgtacctcttctatttgtatataattggtattaattctttatatgtttggtggaatttttcaataaagccatctggtcctggagatttcttttgggggagtttttaatggcaaatttattatctgaatagttacagggctgttcaaattacctatttcatattggttgacttgtggtggtttgtgtttttcaaggaattggcccattttatctatgttgttaaatgtatacgtgtagaattgtttgtagtattcccttattacgcttttgatggttgaatgctccatagcaacccttgtttccttcctcatattggtaatttgcattttctctttttttcctttgtcattctagctagaggtatgttaattgtattgatcttttcaaagagctagctctttgttttaattaaattagtctattgtctttatgttttcaatttcattgatttttttctctatatttattatatcttctgcttgctattagtttattgtgctcttctttttctagttttttgaattgggagcatagattgttgatttgagaattgtattcttttctaatgtaagcatttggtgttattaattttcttttcatcactgccttaactgtgtcccacaaatttcgattttaatctagttcaatgtgttttttaaatttacttgagacttcctttgggatctatgtgtaatagctgacatgggtaaatctctcccacacctcctgagctcagaacaagagtgcagccttttcagcatgttctaaagattattttgacatgatcactgttatgactatgatgaagaaaatatttccaggaatgagaaatcaggtcattcagcctatgaggatcatcatggacttagtccaccaccagcccaaagtgtaagatgtctgctcaggcttccataacaaccatagatgaggttgtgtaactaagagagatttctgttctagaggttagaagttcaagatcagagtgtcagcgtggtggatgatatggtttgttcctgtgtccccacccaaatctcatcttgaattgtactcccataattcccaggtgttgtgggaggggcgcagtgggagctaattgaatcatgggagcagtttcccccatactgttctcatggtagtaaataagtctcatgagatctgatggttttatcagggggttctgcttttgcatctttctcatcctctcttcgcctgccaccatccacataagatgtgacttgctcctccttgccttccaccatgattttgaggcgtccccagccatgtggaacagtgagttctccattaaacctctttcctttgtaaattgcccagtctcaggtatgtctttattggcagcgtgaaaatggactaatacagtgggtttccgctgagggctctcttcctggcttgcagatggctgccttctcactgcatcttcacatggtggggaatggggagagagaaagatttttctcttcctcttcaggtaaggccaccaattctatcagattagggcttcagccataattaccttttacaaccttatttatttaaatttaatattatttactataactttaatttaatcttatctcttaaatttaaccatatttatcttctagattactaaatgtaaccttaattacctcttaagatccctatctccaaatacaatcatactggggcctaggacttcaacttatgaatttggcaggagagggacacaattcactccataatacttgcattcccactaaccctgtactctacaaggaaaacctggctgttactcacatctcacagtttatttctgtatcactcatttttattgactcatactttgtgcaaagctctgcaccagacagcacgtaggcatgccctctgggagttaccacctatcctgggggagagagaagaagaaactttctacatgacccaaccctaagagatgaatccggacccacatcctgtctccaccagttactatgtgcatgggatttgtgcaattttcttatttctacccttcagtgctgcttagaagcaatccctattctgcctccaagagttacaatgatcgaatgatacatgtgtgagatgtgcacgtgaaatacagtaacacacaatacatagctgtcatatggtagaaaatggtaacctgattcaggtcactagagcagaggatatgtggctagatagcaaggagactgaggtaggacacatggaatgggattaaatggtgtggggccttgagggccacgttgtgatacctaatctttattctcaagccaggttaactgtgaagttcagtgcaaatctgatttacagctttcagaaaaccttcacattcattttcatttgatgtatgaacagccttttgaattgcacagggcaggtactgttttttcagttttagagatttcaagcaatgaaatcaaagaggttaactaattcactaagatcctacagctagtaggtagcagagctgggatttccaactcctgttccagtcctgtgtcagcagccctgccagctgctgcaggaatgcacaacccgtcccaggatgggatctagaattaaagcccatttccatgctcactgttccacaaatattagtagagccagaagcagaggctcctccatgtcagcaagattcccctgattgatctgaactgttttgagtttagaaacagcttacagctctaatctgatgtgatgataaaatctggatttcctttcatttgtcaaagttttacttcatctgcatcaccctcatcatgagatatagcctaggggcccaaatcatcgcttgttcaataatgcatattaatggggaattttctcaaatgaaaatgagcgatatctatgacataatgaatgcccaagtttttcccaaatcttaaagctgcatatataactatgaacatgtgttattcacttacatttttatttagtttgtgtagattcagttagtacagtctcaccgtggtcattttatctacagatctgtgaatttgcttttttatttgaatacgttgcacatatatgtttttaaattgctacctttcttgaagaaccctaagcaccatgtgctatacaaatcgcagctaaatacatctatatagagagggatgagtaatggatcttcatgaacaatggcttatgtgatgctggagtttataagccttgtccacaagaataaaaaagatgtcagtaagtaactaggctaaaagtcttgcagtgtaaataccaaagttcctcaaagacgtagacaacaaaatttcaaaatatagcctgggttaatctagtatatatttcctgtgaaaatataactcttcattaagaaagcaaagcattaatctagaaagattcctgatacctggtggtttatataacattttagtgatacccttaagaacaatattttaaaaattatattaaaattataaatacctaatacactcaggtacttaataattgccaaccttaatttcatttctcttttccttctctgctttccataaaagcttaacattttcttctcatttatggtagtttggatgtcaaaagtccctaggctaccataaaactccctggtgcttagaattagagaccctgtaattaggcttaatatcacctgtaagaaaaaaaataataaataaaatttcttatctatgatgtctctgttaataccagagaatcactaaagtcaccttttagctatttctttactctcctctttctttgcaaggaggaggaacttttattttctccacgatgggcttggcagaagctaggagaaatatccacgatctactttgggcaccttcctattcatccacgactgttgttctccaatcaagtgtccttctacctcacctcctccgtgcttattccaatgctttaaggcacatgtggccagtcaatcaaatttccgcccagactctaattgcattgtgtgtcgaagaaaggcaactgacatgaaatacctttaaagcataatatcttcctatttattattaaactgcttttatgggcaggggtggggaggaaaatggaatctgtttgtcgggtagactactgcctcaagaatatgttcatcattttatagatctaggaatgtattacttccaattggcttcatggttaaaactgtgaatgtgaagtcaggccaacctgcattcaaatcctcaaagatctatcacctgcctcagtgtgacttactgctttgacctgtaaaatgagactaataactgtctgtacctcagagggttgctgtcaggattagccaagatcatgtatataaagggcttattgcagtgtgcctggcaactcattactgagtaacattactcagtaatgttagatggtattaacattgttgtggttgaaagacagtgcttaataagtggacagaaaatgccttggattatgatttcttagaatctgtgctaggtgtaacagaaagaattatgagagcaatttaagattattcaagattttcctctaaactttagcttcaaaaatcctagaggaaaactctgaccagtatgtaggaaagttctatattccatctcaagaaagattcaaacaagtaaaactcctgttgtgggccattgtatgtctgttcattgtcatattcctctgcttgaagaaacctgtagttagaaaacagttttccatttatgccattctttcctgagggtctcaagttttctagcatttatatacagagttagtttgtaaaaatacaataaaggtttaaatatttattatgacaaattgttttcatcctggttaataggcaatggtcctgtcagttgggtttgagtgtgggattcttaaaactcagatgtgcttacatgtgtgaggaaagcgagtctccaacggtgttcaggtctagatatgaccccattgcctttgtgtatgcagaactaggcagagcgccatgtttcctcttcaaataagcacttgcaacttatcatagaaagcagatagctttgcctgccaacactcccatggcagtcttaggtttcatttttaatttggttccctgcatcttctctactttagaaagaatgactggctcctatatatggggtcattctcagttttgagtgtgctccattttctgtggcgagagcactgagtcttgaacatgctaaatctgtatgtgaatgttttattatgctctctcctttttttcttacagagttgtctatctttgaatagtttctcatttactgcttagtttaaaagtcatttgcattgaattgcttgagatcacacatgaactagtttagcaaacagtttttgcaatctcatctctgccagagatttggttttaattgttaaggtagccagacatattttctgactcaagcattttaaagagaattctgctaagttttaaaatagaactgtacaccatctctttataacacaacagagtgtttgctatgcaataacaaatgagtagagtataatacttgtgaagtggtacaactgaattctgtccaagaaaactcctccatatggtccctccagctcgtaagtttggctgcaaccctgaagcattctcctggttactatggctgcttatacacttaagtcccatggagttaagaaaaaaatgcagtagagtgaaaattagctatatagcgtgttttaatagagagcacatgtgattcatcctgaatgtgttaagattatatagaaaatttgtaaattttacttgtggttttgtgggaggatgtaaggctcatagattgcatgttgacaaatgtaaaatgcttgcagtgaatcataaaaggcctaaatggtgcttttattgtatttcagggttttaagcaaacatatctgaaatcataatgaaagtcaaagggaaaagattatagcttaatgcatactttttaactttacacatagctggggatggcttgtgatgcataaagtaagatcagtctttactgaatttaccaattcttcatctgaagactccttaaattaagcctgtttgatttctcaactggatgctgaaagagaattaatgttatttcccaagccaaatcaaggtttgatgctccgaagcttccttcattcctttcccctttcagcattttctttcagtttgggccctttgcagtgccattgagaatggagcacgctaaacttttctctctttaaacacacaagatctcttcttgcttaaatggtaatgaataaattactttctgcagcctgacagaaagatgaattgtttaacacttattatgcaggcatctacttaaagcccagattacagttcaattcatatttgattcatagaacttgaagtattcatcctcccacccccatctccccttcaagaaggtcctgggacatcttcctgttgtaacaaacaagacatgactcacgcctcctcattcctgtctcctgccggggtctcagcagttaggcagccaggcagccagagacacgtgtgtgagaaataagacttaagttggatggatcaaatgcttctcaattccctggcccactgctgttcacacaacataaacacagtaatcatcttcatatgcgaaattagggagtggaaatgggctaccagccatctaatgcagaaatttgcggcatcaacagtgagccttatgttggggagagggagtggtgagcaggcaaatactcttccttgcaaaaagccctgctttttgaatgcatggaatgattgtgttgtcctctctgggtactgtgtagagggcagctggggctggagaacagaagagaattttctgttttaattggacaagagagaaatcttttacaaaacagaaccgtggtggtctagaaaatgcggctgtctgccttccggagagtgtcttgcccagcagagcctctttgcatccgtcagccctggcttcagagccagggcagtgcctggcattaggggatgatgggcatgattacctaacactggcatctttctcttttggaaactgcaaccaggctcctagaagcaagtctaataactagtgggcagatttcaggtggtttggaggagccccggctttagggatgtttggcagctggggaaggaacaagaggggctctcttttcactgcaggcctctggagccccaggcactatctctgcagaggtagaggcctgcatctagctagagtggagaaagcatactgtctcagtctgctcaggctgctatgacaaaataccataggttggtagcctaacaacagacatttatttctcacagttctagaagctgggaactccaagatcaaggtgctggcagatttggttcctggtgagggctctcttcctggcttgcatatggccaccttgtcactgtgtcctcacatggggaggggagagtgccagttctgatcacttcctcttattacaggacgcaaatcccatcatggagactgttttagtctattctcatgctgctaataaaaacatacccaagactgggtaatttataaaggaaagaggtttaatggactcacagttccacatggctggggaagcctcacaatcatggcagaagatgatggaagagcaaaggggagcaaagggatgtcttacatggcagcaggcaagagagcttgtgcaggggagctcctgtttataaaaccatcagatctcttgagacttattcactaccacgagaacaatatgggggaaaccacccttatgattcaattatctccacctggccccacccttgacatgtggggattattacaatgcaagatgacatttgggtggggacacagccaagtcatatcaaagtccctactctcatgaccacatctcaatctaattacctcccaagggtcccacctccaaataccatcacatagggtatagggcttcagtctttgaatttgagggacacagcccttcagtccatagcacacacacaccatcagtagttcttagagccctgtgtggcttctcagttctttgcctttgcatgggttgtttcctgagctgaaaataccatcatctatcttgctctcttggtaaacctatgttttaagattcagctttaggaatcttcaaagccctttccaatcttggctccccaggtgaagcataaagacctcagtggatgtctgccttggcacccaccaccctcttggtgatgacatgcaaagctcaggtgcctctgctccatcaggcaagtgatgtcaacttcctctcagtatctccagagcctggccctccagcagcaggcagaggttagctggataagtaagtgagggcagcaagcatgggattaacagctggaaaaagtggattcacgtatttgcagccaaacacctggcgtatagaaggccatatcgcctaggcttgtataagaacattgtatgatgctgacacagtgatgaaaatgcctaacaacagatttctcccgacgcaaccccttcattaagggacacatgtctacactacttactgcttggttctctgtcatattctagttatcagttttctgatttgtgaaatttaggtagttgtaattgttactttgcagggctattgaaagaatccagttaaacttctggggaagaagaactttgcaaatggtaacatttgatttaaatctatcggaaagcttttgggaaaatgcgcacatatacataaatactatgcatgtgtgcactcctcctttcttctacttatgggtcttgaagtcaaacagaattaatttggaagttgaactgcagtctcttccttagctatgtaatctttacttattaattttctcatttgtaagatcaataaaataaatataggattgttggtgaggatgaaataacaacatagtgaaattgcttagcacagcacctagaacataatggatagctacagatgctcttccttgaatcccacacacattccacggccaccagtgtggacacagtgcccctctgactgcctccccacactaacctgacacactcacgtccataccactcatgtgggcaaatgtgaaccacatgcatagtttgagattatcaattaccttttccctagctgtcagtcttatctccccacctagtgtgtaggtttccagagctgaggcaaaccccattctcacccagcaccaggctctgcccacagtgaacaccctcctgtaagtattagttagaggaacactcttatttgtagtgccttggcgtgggatttgggaattgcagagggaatgagtcctacttttatgtgtttgtttttgttttcactttaacttttattttaagttcaggggagcatgcgcagtacgtgcaggtttattacataggtaaatgtgtgccatggtggtttgctgcacggatcatcccatcacccagtattaagcccagcatccattagctattcttcctgatgctctccctccccccatcccctgctccagcaggcctcggtgagtcttaagttttaggcaacagtggtggcttccctgcagttcttccttaccttgctccattggaacagctcctccaaaccaagctccacccgctcctctgcaaacctgaacacggaggtgtaggaggagccttccccagctgtgtcctctcatttcccatagagggtttctcactcatatacagacatgaaacctccctttgtaacagaaatactctgtgtgagagctcagggaatcctggacggtcagttttgcttttataaaagacctaaatcagattaacttggtaaaaacttaaaggtccctttccttgtgccccagaaataggtgcaacactggcctccctcacacatctccacccaaaaggtctcccaggacttggtttggggtttctaccaccagcgagagcaggactggtgtttgagcaaaggaaaggcatcaacacatagtctgacaatgatttttttcctcaactagtgaattgatacctttctacgaagagtcttgctagggtataaatatcaaatcccatatgttacacattacaaaggaaataaatacatgagcagaaatacagtttcagcttcatgtgtctgtgtatgcatcaggtaacttagtatttaaacattttcattcaagacaattctggaatatttaagccaccaactgttgtaaacatgctttacaaatagacgtttgaagaaagacttctatattataaaatttctaaaatttttatttcaaatattgttctgttataaaggtagtataagcccattatagaaatgttgaaatatagactaagaaattccttttcttttcacaaccttaaaaaagcgatagcatttggttgtttttcttctaaactctagatgaattttatatcattacagttaagaacacagtgtctagacacaggctgtcttgggtttaaattcagactctattacttaccagctgtgcagtttagggaaagtcacttactctctctgtgcttctacccccatcatctagaaaatggagatgtgaatagtacctaccacataggattgttgtaagaattaagagttcatgtaaagtattaaagtgagctatcattttatttcacataatcattatcatcctgtccatgtgttttatgtcattttcatttaatgttttatcataattcttttccacatttgacacagtttcttctagtggtgatttttcacggttgcaaaacattttatcagattataatttaactgtttctctattattggacatttatgttatttctaggcatttctattttaagtaacactgctataaataccatcatgaagatcattttttcatagtttacattatttccttaggctagattcccagaagtggagtgccagggtcaaagttgataacattgcccatgatacaccttgccaatggctttccaagaaccttgaatcaatttatatttccaccacaaagtagatgtgtgcttcaactgagttctgttgctttttaatcagcaaatttaatggttaaaaaattgttcattcacaataaacattgttaggaacctcctaggtgccagggaccgcgtctcacattggggttgccaagatggaggtcattggttctgccacgttctagaggaagaaactggaaaccaaatgaacaattctaatcagtgtgattagagcagtgaggtgcaggggaccctcacctactttgggaagtcaggaaggcttcctggaaggggcagacttgagtttagtattgaatgaagaatggtagttaaccaggtagaaaagggatggagggttgttccatacaaagggaagagcatgtgcagaggaggggtgagggggctggcccaactgtggaacttcaaggaactgggtattggtgtgttggaaggaggattgagagatgcagctggcaccaggtcatacagagaagctgggttctgtgtaaagttatgatttttcaaagctgcttaatatggttttgctgtgtccccacccaaatctcaacttaaattgtatctcccagaattcccatatgttgtgggagggacccagagggaggtaagtgaatcatggggactggtctttcccgtgctattctcgtgatagtgaataagtctcaggagatctgatggatttagggctttccacttttgcttctttcttattttctcttgccgctgccatgtaagaagtgccttttgcctcccattatgattctgaggcctcacgagccatgtggaactgtaagtccaattaaacctctttttcttcccagtctcggatatgtctttattagcagcgtgaaaacaggctaatacactgctttttatttgttggttggttgattggtaagttttaataataaaagcagcctcagaagaaccctgcaagagaatttctgatgatatacgatcagatttaccaactggctcacagtattaactgttaaattaatttagcggtatgggtgttcactaaaccaagctaacctgtaaactagcagcattggtgcttcactaaatgaggttagcctgtactgtggctcatctggcagcatagtgaggtgggcaaagatggtcttcaaagtctcccacccaccccacctcatcccttttttgtttttctgcttcttcttattcccaccagaggcttggagacctgccctgcccttcccagtccctctctaaataacctctcaacaccctggaaaaggatggttgagacaaactcattcgcacaatgatgctggcgattggttaagaggtccagccctcacctctccagaagcaattgaattcttgagggggtcacctggaggatagatattctttcaacccaaagagtctccagtagtggaatttcagatcagaaggccagcaagtaaagaagctatttaagatcaagttgggcaacagtgccttcttggccccttccagggtcccacatgatgagacgtctttgtgcaatcccagatctgaatgtcaccttttgtcccactgtccagggtcagcttcagccctaggattgcctccttcatcttgccttctacatggagtgtgaaatcagtgtcctgggataaactgtgcctgaccatcagcttttcctaaaagctggtcagactcaggacaatggccagaggctgggaggatgagggcttcagtgaagtggccacaattccatcatttcaaggttgcctacttttctagccctgatttagaaaggaagaaaacagatatcttttctacctttgcaatagcaaaaccacaacaacaaaaaaagcgatgaacaattcatctaagacagtgttgttttttttttctcacctcagaaaaacattgtaattccttctcagcagatttcctagatcttaaatatcagctcaaacatttatgcatgaaaaattagaggccatgaatgatgcatgtattctggaaagtctgcctgtgaatctctccccctcctttggaaagtcccaggatggcagccaaagcctcatttccaacccctatttcaaagccacctgagatgaaatttcctatttgtttccaactcactcaccctttgcatattcaactctccctggaggcagataagtctgctattatcttgtctgagatgttgttcttttacttgaccagatgatagcacaattgtcagtttgctctttaataatactacttcacaggggatttgtaaagattaatgaaattatgtttgaaaaccactttgaatttgtatgcgttctttctcccgaggcgcggggttattatttcttagtgtttatactgtatcgcccatgtaagaagttttaaatactctgctaacatttagaacggtttaagttagatgtgaagccattggctattagagctggaaggggtcctaccctcaaactgaggaggtgaagagaagtctgccgcctggagtacagggctgatttacgtagtgccatgcagctgctgaatggcagagccgggtctagaatccagggccccgactccgtgttcgcatcttcagctccgttataggttaaattgtgcccacccaccacccccccaccccgcaaaaaaaaagagaaaagtatatgttgaggtcctcacccccagtacctcataatatgctcttatttgaaaatagggttgttgccaatgaaattagttaagatgtggtcctactggaggaaggtagatccttataagaggtggaaatttggacacaggcacacacagaaagaacaccgtgtgaacgtgagggaagccatctgtaaaccagggagaagggcctggaatggatccttccctcacagccctctgaaggaaccaccaccttgattttggacttccagcatccagaactgccaggcaacaccgttgtgttgtttaagcccacccagtgaatgggatttccttacagtagccctaacaaactcatacaaagtttttcctacttttaatactaattattgccacttagcagattaagagattgaggcattacgaaaggggtcattggtccaaggctggaacgtctactggagagccaagtaatgaacccagaaacctgagctgcttttcttcactctccctaggcatccctcggggctgctagagttgggcagccctagctcgatgcccctcactgtgggtatgggcacctgatgcagcccataatgacatcccagtgccccaggggctgcctcctggcaccgctccatccttcccattgtcagaaggcagcagcagggctgagtgcgggcagcagaccagggacccttgtcatgtattgtttgacaacccaggaggggttttaaatataaatgggtggagatagcttctgagggtctctttgtcaaggaggcattggatacacagaatccattttcctgggacacagcatacgatccatcggggctaagttctcagtcctgtccacaaagcccgtgtaagtcagggtgttccagaagctgagggccggcagtgctgcttgctatttgggaagtcgtcagtgacactgaagaggccctttcaatggtgttgtcagggagagcagagagaaggaaggcaacaccctcagctctggcacccacagaaaaggggagaagggagaggagagctcgatctgagggctcacacgctcaaagaacaggtattggtggtttattttccacactggagaaacttgagtacatttggaaatcaggaaaggagccagctccgtgaaagcaccaatgatacccaaggaggcctagagaggttaaggcacatctcaaggccatactggaagtgagaaatagagcaaagactcttgcttgccagtccagggctctccactgtgcaaagatcatcccaacttccacccattgtttccaatgtcacagatcacccttgtgatcagttacttggtactattgcaagtcagctagctaaacttaaatatttaacctcatctaaagcaataacatccacaaaattatgggtttcttgtgttatataatcattttcttaatacttatttaattaaataaatacacaactatttttcaagtgttttttttttttatttattttttatttattttttgagacgcagtctcgctttgtcgcccaggctgtagtgcagtggcgcaatctcagctcactgcaacctccgcctcccaggttcaagggattcttttgcctcagcctcccaagtagctgggattacaggcgtgcgccaccacccccagctaatttttgtatttttagtagagatggggtttcagcatattggccaggctggtcttgaactcctgacctggtaatccacctgccttggcctcccaaagtgctaggattacaggcatgagccaccgcacctggccaagtgtttttattttttattggttttgcatatcacgggtagtagccacctagtctgtagcgtgggcagctttgcaccaggggttagggaggagagaatcagagtcagggacagtggcttagaatcctaaaaatgggggtgtggacatgttgggagcacagggaggggaccctctccccaccagtataagggcaagtaggttcagggacagagtgacattgaaatggaggtgaaagaagatgacagcactcctgcccactcaccttaatttgtcaacaaaaaaaaaaaaatgacaaactgatgacaacttgaaggtagcaccgagttttagatcttaaattaaaattgtattatagtcatctgacactcaaccatttttgccacaaagcagaggtcagttgtttcaggaaaaaaagttggactttgaacctcaactctggtacttaaatcacaactataattgcatctggattggatttggaggttgacctttgatcagaaacattggtttcctaagatgaggcctctccctgacaaaaggctggtttgattgcttggaactggagtgaatgttggtcagcacctaagagcagcttctaaaggtctggcttgacccctccttggcagctcaacacattgatcctaaggaaagctacggagggatgtgccaggcagaccctgtgctaggcagaacccaaagtacctgcctggagtcatcgtgcaagggcaggtctcccagcccaacggtggtgctagaagagtcatcacaggactatgggtgtgctgccttcccaaccaggaactaggtagaaaatttcactgtctgttgatccctgggagagaggaaagatgatggcaatagtcacatgcacatactgttagagaagttattctgacacttgttagaatggcgaggaagacttcattcaagactgttacaatggggccactgcagtaggggagatagtagggaagatagtgctcccgatacagcaaggacaagtggggtttcatagctatgaagcagatgagtgggtcaagggaaggggggtttcttgctaaactggcttagcaggattgttactaaaactgagctgacaggacaggggccaaagtcaggaggaaggctcagaggagcctgagacagtctttgtcagcactgggtgctcactaggtgctagtcactggactatatgctctgaaatgcagttatcacaccatcccctgaagtaggaaggcttatttcaatgtgatagaagaggaaactaaggtttgccccttgtcgagggcctacagatgatcagatgggagatgtggatttgatttcagggtcctctgatcgtcatgcacaaagctttcccaccactaaatgattcctgatgctttgtgaggagctctccttccttcagagatgtttgtaaaagagcagaggcttctgtgtccagaatggtcaacacagacaagaagtggggggctgtgtggtgtaatttcctcatagctttgacatctaaaagaccatcaggatggctaaatagtagaaaggagagctttattgatgatatcagtttgcaaaccaagaagagacagtttccagcatggacctaaggtgctttcttttcaaagaggggaagggtgggctgtgttttatgcctcagaaggtctgtgtcacatagtagatattcaccaggtgaatatcactgtacatattcaccaggtgtggaggaaggccatacaaatttatgaggtgggtcaagcacatgcacaatggaccaacacataggtaacaaacatcccatgttcactttggggcagggctttagcattaaaatgaggtagaatttggctctttagggcaaaaggtgaatgacagggcacagtttgcctacagtttctatgagctgctggaactggcttaagggctacagatgcttatcaggaaagagtgtttataaggccagtcctctgtctattcagagttgtagtggtctgggttgtaagacagagttaggaggagtctgatattttgcctgatggctcctactgttagaaagtttaggaagggtgtgatttttctcttaactgtaagaatttcagaggttgccatgctcactgagtccagagccctcgccaatagataatcttttccccttaacctttgtgtctgtcttagttcatcagggggcgtctgttttggtctctcagattacaaattcttcagacgccttgattctcaaattgtaaatcttccttcctcttgccactgtgagctctaagcaagttcaaaacctgagcctacatttaattcctagatagggaatttgagggtttgttttagcaaacacgtctggtggctctgcccttttcctcccctctctttattcactgctgataatccctccccatctttccaggctgtccttcccttaatcctgccagtagaaaccctgactatcttcaaatcccaactcacaggccacctctttcccgaaagctcctgggggttccaagcaggagctccctctcctgtgtcctttctaatgcccagagagctgtggccatactctgtctcgtgacataatatgcctggctgtgactccgtgaggtccgctgtagagatgtcggcctcaccagagcagggtctgggtctccccatccctgacttaataaaatggctttgagtagaaatcatttaggtgggaggggcccaggccctggcctctgcagaggagatgcagccaaacactaaatgagattcagagctactgaaaggcctgagggttccgaggtgtctacctcatcctcctcaatattagctaatttgacttcctggggtgaagtgcaaaaggtattccttgcagctcaagcactatttgaagcctcctattaaaataaactgccttggagggcacattaaaactgcagagaatccttcattagacctactgatatcagcaaaagtgctgagtacctactgtgtgccatggtgacgtgagattagaagaaaagtgcaaagatgaataagacccaatccctgctatgaaggatcctcccagtcaaggattgtggggtcagtagtgggcacagggcaaatagtattgataacaacagtaactataaactataagaagagctctgataataacgctaaatgtattgaagcacttactatgagttcgacactatctcgaagcacttaacagaataaatgcgttagtgctataagccaatgagctaggcattattgctatcctcattttttaacaagggaaccacagcacagacaggttaaaccatttgcccaaagtaaacaattagagaaaggtggagctggaatgtgactccagacagtctggtgccagagctttgcactagaagaacagaagaaagaggggttagctttaccctaggacaagagtcaggggtgcgggggctgtccagtgaaaatttcacaaaggaggtggcatgatatctggaagagtaaatatcatgtaaccaagtaggaaggaggagaagagggaacagcatccttaaagtcacaagcaagagcatagatactccaggtcttgttaaagaaaagcattggctgggtgcggtggctcaagcctgcaggcccagtacttcgggaggttggggcaggtggattgcttgagttcaggagttcaagaccagcctgggcaacatagcaagactctgtctcttaaaaaatgaataaataaaacttaaaaaaattatccatgatacttgttaaagaactgtaaggcagagtttattccggatgactgcaacagaggtttcaccatacgggctggagaatgtgctcaactcagaatccaacaagaaaaagtgggaattgatagccaaaaaccaggggagggggaagttgtctgtgtatagaaaattactaagaagaaacatcagggatggggggattctggccaaactgacccaacaggagccatgcaggccagggtaatcagacatgacctgggggatggtgaaggatgggaaattcaatcagatatgaagagtaggggattctggctaaattgacgtgacaggattcttgctgaaattgggctcgtggaggccctgcccaagcatggggcttagtggggctcagatgagcctgattaatgtttggtcacagacagaattcttgtcggtctccagatcatttggagtggatggaacatgctgtcagtctacagagaggggaatcttagagcaaggagctaggctcagcaagcctgggagggcaggggctggaaagtagagtgaaaggaactaaccgcagagcctttcacagggcctaccatggttctaggcactggaaataggtgaaactttcagtagtgatgtgaggattattctacctgttgagcaaactggactttcgagaggcgacatgatccagagctggcaagtggcagagctgggattggaagccaggtcccactgatgccagcgccactggaactagctgtaggagttgatactaagggttcgggaggcaggcagccctcgtcagcaggcatccgaggacccgagagaagcagggccatggtctagggaaaggagcctggggaacggtagggggaggtgaactctgccccagctcctcctcactttctctgagtcctgatgcccccggtgagtctcctgtcacacaaggctgtctggacaggatcagtgctgattggaagcaggatgagagacgatggcttgggtaggaaacactggctcctgtttcattgcccattagtccctgagctgtagaaccccccctttttcctgacttgctgggagtggatctgtctctacttagccagagggaaaagcaagaccagctgaatctgcaaagctaagtaacctggttaccacagggcaggagaaaatcaatcttgataatcacatctggcagtatgtaaagccattttgttcagacagtacaaattcgttttatggtataaaatgctgtgtatttattgtgaagaaacactgaactcatcagtgctctacctagtgtttaagatttccattccatggagaacaaggtttcactttcttcatgaaagagatatagatgtgtgaagtgcttgtgtacctgtgtgacatacgccctggctaaagactgcatgtcagctgaggtccgcaacaaggaagaacagtgcccaagccattgaactgtgtttctattgatacttgtgtttccaaagctgattttttaaaggaagggcttatgccttggaaggaagagtcaacatctgaaaatgttagctaatttaatttcccgaagagaaatgcaaaagggattgaggtagtttattatgttaaatctcaaataaacctggacaattaaaaatggaaggaaagccaagactaattaaaaggagaagagaatgagaaatgccagtcatctgggataaattgattattgcagttgagcactaaatttagctctcggcttctttgtggctcaggcattcgaaaaataatttgggataataaagttttttaggtttatttacagaaagctaccaatgaccacaatcatgacagaacacttatgagtaaacaattagtttggggattgaaatgtaaataggactagaattcatgaatttgttctcaacatttttcctctctgacaaaactcatgtttgatattgtgcctttgcttttgtactcagaccccccgtggtgtgtgtatgcctggagtgagaggaggtcatggttcctactttattttttgttttgattcctttcttcccaaactgttctggaattgttctgaaggtgttatgtagtctggaactctaaaattccgaaggtactacagcaagacaggagggaagacagcatcactgactccctgcaggatgggcacagctgcctctttctgtcacctcttcactgacattaacagtccagcacttaataaacatcctgaagctcccattttcccatccccactcccagcacccccttcatgagctaaactacctggagatgttgccatcacagactcctcaacaggagggcgatcgttcagggctaggggccaggtgaaaagagagagaagtttcagtaagttttgggggaattcgggagcattgattggaaagtgaatgacctcaagggagaactctcttctgggtaggacggttcctccttagctgagcattagttgacctcatgatcactttggaaacagagagaaattgtccatgtttgaagtagaatttctacatttatcttcagcatggaaccctgaaacgtagaaataactccagggatgattgaaaccaaggaagcagagtaaaatgcaacctaccagggactttaataatcacccagataaagactttaaaaacaacacacacagctaaaagcacaggaggggaagacgtgcaaattatatttagaaaggcttaattttttaaactttttcattttcaaaatcagagatgctattagcacactactgagatggcaactgcaaaggtatctgtctcagaagcacaaaggcattgaacaggccattaacattgaaggcagtgggagggggaagggaggaagcctgggttctgttgcacaccctggtgtcaagtcccaagtcggccacttccaggccctgagctggtgagcgagtcaccctgtctggatctgttcctataaggtgttcctggcattgataccgtagagaaagaacctgtttgtctgtctctttgtttatttattgtattagtctgttttcacactgctgtatataaagaactacccgagactggtaatttacgaagaaaaagggtatatttgactcacagctctgcaggcttcacaggaagcatgactgccagacctcaggaaacttacaatcatggtggatacaaaggggaagcaaacacctgtggcaggagacagagagatagagcgaagggggaagtgccacacaccttcaaacaaccagatctcctgagagttcactcactatcacaagaacagcaagggggaaggaagcccatgcccacgatccaatcacctcccactaggcccctccccctaactgtggggattacatttcaagatgagatttgggtggggacacagagccaagccatatcatttatttatataacctcctctttccttaaggtaagagttcagatggttgacataaccatttcatgtaactgttaacagcaaacaaacaagcacacggaaagccagggatttaaaactctacctatctcacagggttgtagtgagaattatatgtactgtttatgaaagtgtttactttttgatgggcacatagtagatagtaaatgtttgctgagtctgaaaatatgctcctaccagcctaaggagctgatgcactgtcggttctgcccacttaccttaaggagagccagagaaagttcttctctgtagcctcctttccctttgtgctgtcccacaccatccacccaaataatgcctatcactctggccaagatgctgtctgtggctgttcccctgcagcccagccatccctggtgacttcagcatggaacccccaaatcacatttgattcccaggggtatcacatttggtctgatgggcaacattcccatgcctgtccctctcccacactcttttggtgttagtgacctaggtcacattagagaaacttctgttctacttttggagccaaagtctgagaagtaggcaacaaaggggatctgggagaatcaattaatgatcccagacacctctcatacatttttcagtggggtcctagaggaagtacagtgtcagcaactccaggctgatttcagcataagtgaaatgtattcaagtgacaaaactcacaagcagaactaggacatgatcttatccggagtcatttttttaattattgttgagaagcagaatctagttacagagaaatgatttgatgcggatgcccagactctagctgtaaaatgagatacagagtaacatttgtccagtgaccttttcctttcacaggacaattaatagatcttatttttgtagagctatgatcttgtcagtttaaatccaacttgctgaccaaactggagagaaacctttgtctccaacagaccaagttctcctatctgccgctgcttggaatcgagtttgctggctggtgtgagtggaatttcagatttatcaggccagccgtggagcagaaataataaacatgggattcgaatgaaaggaaagcagaaagtagaactcatttaagacgaatgaaaccctttaaatgaaagtgcatctttctcaataatagaaattctaatgttcttggagccattattataatagctttctctggagtatgcaatacattaaggagtccaagtcagagcaaaggacaagcagccgggaatcatttgtccactgagccaacagcaagtcatcagccatccatatgccttggtttccccatccatacgctggtaatggcaactgtcgcttggtactcctgttgcagcatgtgaaataacaaagatttacaaacatctgtttgctttaatagccaacaaagttatgctggtacttatatccaacatgaatggactaaatgctcttttctgggttcacaggcctactggaagacctgataattaagtgaacgatgagatttactcaaaataggtgtcaaggacaaaaccagggccaatgtgtggaagctttagggaggttggttttatctcaacctaaggaaaattgtatgagagtaaatctaggccaggtgcagtggctcatgctcataatcccagcacttggtgggactgcattgggaaggtcacttgaggccaggagttcaagaccagcctgggcaacacagtgagatctcatccctacaaaagattaaaactagccaagtgtggtggcttgtgcctgtagtcccagctactcaggaggctgaggtgggagaattgcttgagcccagaagttcaaagctatagtgagctgttattgtgctattgcacttcaacctgggtgacagagcaagaccctgtatctgaaaaaaaaaaaaaaatgtaaatatgttctgttgataaaaagcaccaagtgaaggtgactcacatgtcacagatgtttcagggatcactgcattggtgcaacatggtgagacaatatgccatttgagatcccatccaaatctaatattctggattctaaaattttattaattttggatgtgtagatgagtgagagaagacctctaaacaaaagctcttaatatttctcttctgtgggccaccaggattgggtagagttgtcacagagcccctgcctctcccgacttgctatcacataatgaaatcttctcagcatggaagggcaggcttgcaacactttggaatgggcaccagagagagtggacaaaagaaaaaaaaccacacacaaaaaaacaactattcacccagataaggcacaggcattaaaaactggaaatagtctgggcatggtggctcacacctgtaatcccagcactctgggaggccgaggcaggcagattgtttgaggccaggagttcaagaccaggctggccaatatggtgaaactctatctctactaaaaatacaaaacttagccaggcatggtggtgtgtgcctgtcatctcagctacttgagaggctgaggcacaagaatcactggaacccagcaggtggaggttgcagtgagccaagatcatgccactgcacccagcctgaatgacagagcaagactctgtctcaaaacaaaacaaaacaaaactggaaatggaattatgagagaccagccagtaggtactgggacacctcacaaaccacccaagatacccagctcttaacagtcatactgtggagagctgagaaagttgccttaaatgtgaagggtaaatttctttcctgctgcagaagtcctctgtctaagatttatgcctcaggagggaatggtggctatttaaggacaaacatcttcttggtcacaactggtcattaggacggtggaaacattatgatagaaagagcctggtctagaggtcaaggagcaagcatcgtccattcaaagtcagtcttcactgaaaatctccatgacagcagaaatggcgcctatgtccacacggttcattacagtgcctggaacttaggagagactcaacaaatgaccaggtgtctgatgtcagctctgccactaacaagccatgtgatttaggacaagaagacacaatcttagatccatcagctatgaaatcatgatgaactctagaaccctatgtcagacaactcacacctctgttcatccatcctaaaatatttgctgagtgtctactatgtgtcttgcaggactgtaggccctggaattgcagccaagaacaaaatattccctgccttcatgaagcatatgttctagtgagggaagacagacagctaacaaatataagcagatgtagagaatatatcaaatggtaataggtggtaggaagaaaagaaagcatggcaagggagcactgggaggcaggtgtggcatgcgggtgttctttatacatatatttatagagagttgtcagagagaacctcactaatgtgatatttgagcagaaacatgaaagaagtaagccacatggatttctggggagagagcattccagacaaagcaatagaaatgtggtttacctgtgtaacaaacttgcacacatacccctaaacttaaaataaaagcctttgtaaaaaagagatgcaatcacgattatgttggcaaattgctgtaattatttttataagacttactacaggtgaaggtctactgagattgaaaaaaaaaagaaagaaatgtgggagttgctagcaggtgcttggtattaaagccacgagacaggatgagatgaccagagaaagtgtaggtaagaaaaaaatcattccaagaaggctttgaggcatccaacagtcataggtcaaggaggtgagaggaacccgtacagtggctgagagggaggtagaaggagaactgagagagtggggtcccagaagccaagagaagagatgcttggaagaggaaggtcattttctgtgtagaatgctgcagatattttgactgcagcagaagctgagccttgactattggttttagctatctggaggtcataatgaccttgacaagagccatttcgggggagtggtgagggagaaagcctgactagagtgggttcaagagaggatgggaaggagattggaggaaatgtatattgacagtgctttagaggagttctattgcaaatgtcagcagaaatgggtgggaggtagctggataggaatgtgattttcttaaagtaaaagatgctctatttctatgcttagagagatgatccagtaaggagagaaagtatgatgacattggagggaaaatcctctgcccgctgcagttctccccacttctgttattaccacgcccgtcaaggaggaaagcactactcgcctctcctaccctggcttaaggggaaaccacagccctccctcagatatcatcagcaaaactgtcactaaacttgaaaatctaagtaaggcctgtctacaggcttagaaaaaacaatagaaaatcaattcaaagaacagtaataagcaacaagattggtgtttcactgcctgtgctccccatgctctgtggaatgctgataggtcaggtgagtttaaggactgctgagttaaaaaaaggaaagcagatgcatggctgcaagacttcttggaggctttaaaggctggtgagcactgtgtatttctaagaggggcaactagtgtgaggatttttcccaccacatttggggaagtatgacaggggactagtgttgcaaggcatacaatacaggaaagagtgaacaagatcaggggttggcagacttttctgtagagtcagatacaaatatcttagattttgtgagccattgtctctgttgcaactactgaagcctgccattctagcacaaaaacaaccatagacaataggtgaacagatgggcatggctttgtttcaataaaactttatttacaaaaacaggcaatgggccagattaggcctgaaagccatagtagtttgccaaccattgaaccagataatctgcctgaagagatgagctcatcttcctgcagagacacccaggtctgtccacagggatgccaagttcctacttacctctctttggcaggggctatttttctttacctttcacttaggagcactctcaaatacgcttaaattctttgcaatttagcacaaaggtctgagacctagaatggcccatgtagatcccatttcttttctggggccctgcccttttcctcatgattcacaccagaggtatccagcttctttgccatttttataaaactgtttgggtccaaactgaaaataactctgaatcatccagattgtggcttatccagtaggccttttgcttaagtgtacctcctcatttcctgatttctgtgagggagacaggggaggggaaatgaagtgaatgcctgccatgttggctgcttattgtccctgttgaaagcttttgtgaaaaaatgagtcttggaaccatagcacatgaagagtgattagaaaatatttgcctattggatctgaataaaagagcacttgtgaggttatggggaggtggcagtgggggtgggaggtggaaggatggtagtggggctttttcatggaaaggaaatgaagatttttttctttgggacccaagggatggaaccaagaccatcaggttgaacttacagggagcaaatttcagctgataagcaggagtcactttgattttgtcagaggggtggggaggcagcattccatgtgagccttcaggtagaggctacagaaggaacactcacaattcagatgtgccagtaagctggtgccttcactgggtctgctccaaccaagtatcatatactgggtggcttaaacaacatacattgatttctcatagttctggaggcaaagacattcaagatcagggtgctcacatggccggtttctggtgagggccttcttcctggctcgtagacggccaccttcttgccaggtgatcacgtggaagaaagagacaaagctctggtctccctttgtcttcttataaaaacactaatcccattatgagggccccacctttcgtgacttcatctaagtcatctatctcccaaaggccccgcctccaaatgctatcacactgggggttagaatttcaacctatgaattttgaacatttagtctatagcagtgggataactttttaaggcccctttcaatcctggtcatttatgacaggcctccacaaccccaaggccatggaccgatactggttcctgttaggaatcgggccgcagcagcaggaggtgagtagcgagcaaggaagcgttaccacctgagctccacctcctgtcagatcagtggtggcattaaattctcatagaagcgtgaaccctatcgtgcaccgcacattcaggggatttagttgcacactccttatgagaacgtaatcgctacccacccccctgtccgtggaaaaactgtcttccacgaaaccggttcctgatgccaaaaaggtaggggactactgacttttgaaactgaagtaatccactcaagcatggttttctttagactgtagattattgctttcacatagtgtcctactattgcgctggcccccactgtcattaaatatcacctatatttattggctggagtgaaatatgtcagaatatcccaacaggaatgattgaagagaggattcaccaacttttaagagacaagagttaacaccaatgccacctttgtatagctctggtttgagcagggtgagctgaaacaaggcactctaatccagagacaactgtctgcataggcttgtggctttgttcctgtgtcagagatgtgagcagaacaaagcaagatctgaaagagcaatgtggtgccagaacatgaaactcctagggttgttgcattttataatggaatggaaaccaaactcaactttggcacaaacaggacacatcagacctcttttcccttttatcttttaaatgtcttttctcagggaggtgttcaaagtggcttttaacaaagcatcttttatcccatgtcctcaggatatttacctatcccagatacctagaaaacctgctgaggggaccaggttagattctgggccatgagttttgctgtctttgttgccagtttggagaaattcaataagtaaaaactctgcaggagtttgaaagatctgagtgtaatccctgacacatgtgtgaacttcagcatggcccttctctgcttcttttttctgttgtaactactcgactctgccattgtaacacgaaagggccatagaccatacgtaaatgaatgaacatgcctgtcatccaacaaaaccttacttatgaacaccgaaatttgaatttcacgtaatcctcacgtcataaaatattctctttttgatttctttccaacagttaaaaactgtaaaaaaaaaaaaaaaaaacttctctattctcagctcttgagttatacaaaaataggtagtgggccagatttgatctacagattgtaatttgcccaccctgtgctagaccctgagtatacagaggtgaccacatttaacttgatcctagccttgtggtacttacttatgggagaagtggatactaaataatttgaagagtttttcatgtaatcaccaattgcataggaaggaaaaaaaagggtctcattaggaatcattacaggaaaacatcgtttaaattggagaattggcaagtcaagtgggtgcaaagatttaaggatttagccaggaaagagtggatagaaaaggaagtatcccaggcatagggggaatcataagctcaaactgataaactgagggatggtttctatccttcatcactgacctaccagtgcttcaggatgtttccagagagactgaatggtgctgagcttgctgggccaagtgtgagggatgaactggtaaaccaaaaacaaaattctgagccacccaaccgactgaatgcacccctccccttggccaagggggcttccaaggaagcctaaaaaaaactagttcagaccatgatgggaaggagggggtcagtcatgcctcatgatactctccttcctttggaatgcaggcacaactaactggcattaacatgaaaacagagacctgaaggctgacaaaacagactctttgtagtaataagatactaacttccagcctgactctagtgtagcatcacatgacagagagcaggccctgaaagaaatccaagtattttaccccaaaatatatttctgtgacatattttgaaatggacctgcagagctgtctcttgtgggggaaatttacatttggtagagaatccccttccctgtctacgtatttttctgatcctgacaagattagctgaaactcaggtaccttttaaaggtctgaataggaaacatttgcgatctattgcttctatgagtggccacctatgagacttcatcttcataataagaaccttggtctctgtaaccccttatcttaacccagacgtgcctttctattgattccaagtctttggataataaataacttaactctgtcgacaaattgccaatcagaaaatctttgaatctacctctgacctgcaagcccccacttcaagttgtcctgcctttccagacagaatcaatgtatatcttacgtgtattgattgatgtcttatgtccccttaatatgtatgccaactaagctgtagccaaccaccttgggcacatgttctcaggatctcctgaggctgtgtcacaggtcatggtcttcacatctggctcggaatacagtttcaaatatttttatagaacttggctttttcatcaacaaactcacctccaaatgtggtagcctctattgtccagctatagtccttccaccttctttagcatcattatgtatttttgcagaggttcaggactctttaacctgatctttgtcattgttgtacctcccctgagggaggcaggtgaggggtggtgacattatcaagcaaacaggaccctctgtgtctggtagtcaggcattgtggtttccagatcttgttctaccaccaccttgttaggtaatgctagacacatcacttaatccttgctaaactggaaaattaagagattttatatattaagagtctccaagcaggtggcctggtgggactccaagcctctttaaccagatcagccctactcatgtctgtcttatatattaaagagttcattcaaaataggatttcataaaaagctcactggacttgatggtttttgggtcctccccaggcctgaccctgctgggattctatgagcagaatctcttctccaagcctgtccatgttggatcctgaatatgtctggggcctccctggggcaaatgagccataagagtgaccatccaagcttgttctgtgagaataaggacaagtcaagccattttccccaggaaaatgataaatcccatcctgctggcaaaatatcaagaaaaaaacaaaaatatatgattcatatcgagtttgctcagctttccgttgcctcagtagtgccacaggcaattagtaatataaactaggtgttagccttttaacctcccagtaaatctgcatccaacccttgaggcactcacaccctcaggacactgagctggtagagttcctgtcccccgcccccaccttcaggtgtcctcagaggcatgcctggggctctctatctctgtccagcttgaacatgcttctctcagagtttctatctcccctaatccagataggccaatgagcttcggcctctgagtctggtaaggggcatcctgacaatgaatgccaggacgaggtctggaccctctgctgaatctgcccaggtgctgtttctgagttgcttgaacccggcatcactcctctggatacacgctgtacccatttgcatgactttcctgcctgcttttgttttttcagagaactcttcccacggctcacttcactctatggaacactcagagaagctgagtgagcaccataattctgccctgtcctctctgggtggccatgacactgaagaaaaaatccactggtactcttgatgcttccaccaagattaatggagccgttagtatccaggccacagtgtgcacctgcttccctttgttacagccccggcccctcccctggaatcatgccacagctcacaaagtcttccattcatatccttgcatttgatactcaagataaccctaatactttaggataggcagaggacacatgattatcccctgtgaacacatggggaaaccgaggcaccagaatcaagtcattaaataggactggagctagaactcgtgcccaatgtcttgataagtattaaattaatatttgtaaagtattagaacctgtctaggggcttgctgcaacactaggctcctgctctcttgccccttcactccctgatatttctgtattgctttcagaggccatttgccaagctgtgaattggctagtttgaaacttcttctagaatgggaatcagagagcaaatttctctgcatgtaggcagagctgtgtgaaaatgcagttctggttatttggacttccagaaaggaatcataaaatagactaccaacccaattctgaaacctttaacccagtgtagttggtgacccagcagtcctcacctttccacctaggtgggtgtccctctgagctgggctgttaagaaatttgctgctaacccccagtagaaatactgagccctttcatggtcctccaagttaagctgcctatttccagaaatacggcctgggttccttcctactcctccacccaccaaccaacaccatacctcttctactgtttatgccccaactcttaacgtgtccccagactgtccttttgaatcatctcaacctatctttggctcccacaaagttcaatctggcctgaatcctctgagctctcagggccacccccaccatgcaatcgacactgtacacaaacagtcctgagcacgtgagcagcccccacgatatcagcctgaaacacttgcattgcccatctcccagcaggcttaggatctgtttctctcatttgcttcttctccaatgccaggagctacttctttaacctcagcattttgtttcccacataaactatgatttaatgtcttcctctacttcttcagccttcatttccaaaatttctatgtgttttctctttgataaccacctcctctcattccataatcacctattcttttccatggatgttattacgtcctttatctctttgagtaaagatacttgtttaagagccaatttaatgttactctatcagctctgtttccccatgtgacttctgtttgttgtctgccttttgtggtgttactctcccacaggcttgagaatttttggtttatgagctcatcttctgccagaagccaccattctgaatgttctgggtggtatcccaggaaaaacagtcttggggggtcttagccctagacttgaggggaagtggttcccattcaggcttgtgctggccactggtctgccccacgtgtggatgggtgatgtggatctgagctctgtcctcaccggagtgagctctgggcccttgtgtcacgtgagtagcaatttcctcacctcgccatgggtaatcacatcacccccaatcttagggagatggtaggggtgggaaccacacagcttagcttttcaacaccagtgagcatggtgacccagcccccagcctcatgagggtggtcttgtccttactacaggcaaagagcattggcgtattgcccatttgatgttccttttgttttcatgttttagggtttaaggaatccccattttggtctcatgagatgtctctttcttgctttcaagtatggatatatatctattaactctttttacacttaaatagttttctacctttgccagtgtttggtgtggaaaaatgaagtgtcagcttatgctcaattttctatcttcaagaagaaactcaagtgtcttcaagttcaaattcttcccttctggtccaggcaggtccctgaaaatctgcattgtactgcaggccctgcaaacaaagccctggtcacacacattcttgtaccccaaaagccaactcattcaacagcttcatttaaaagcccccttggtgcttcacaattcaagcctcctcccttccttaaatatgactccacgtcctctattaaggaatttttctgcttaaaaacatgttatgaagtgagagagttgccatcctactcctggcagttagttcctcgttgactttgaaacattaaaaagtacttaagagctcacatttttattttatcacatctgggattgtgccttatactaaggatgttcttggtacagcacaggccttccaattacatagtactcctctaggacagagtgtaatgtgttttttttttttttgcagagtcagatatttaagtgaattttattgtcaggtttgctttgtagtcattttaaaaccagccactgtttcttaagctacctcagagggtaacttatctattgatgacacagctatatcattttacagggttccataccacatagcttaagtgcctggacatcgttattttaaagtagaggaaaaaaattttttttttggttcatgcttttttatgtgtccttttacatgtacttttaagtgtccatatattttgtaacagggaacaaaagagatggcttaaggtgccttgtaatatttattttgtaatacaaattatatgtttataatatttatttctctcagtcataaaagcaattcatgcccattatagaatattcatcaaatatactaatgtatgaaataagaaaataaaaatttctcatgctcccatcatctcaaggcttttaatcaatattaatattttagagcatttccttccattcttttttctatgcccatcagtatacattatagtatatattctgtaattgaaatctgattatacatagctttgtagaccaccatttttcactaaatgtcatgtactattaaaaccagagcctgatgccctttgctctctagacccatggctgccctattcctacttgcaagactgtgaagccatgagctttcatgatgtccctaataaaaactgttaggataagaacaagctgttttaggatcatgccatgccttagtgtcacctctaggtttctatgctgggttctgttacactagtccatgtcaaaacaaacaaacaaacaaacaaacaaacaaaaaacaaacaactagtgttctctttttagaagtactctctgtaccgggcatggtggctcacgcctgtaatcccagcactttgggaggccgaggtgggtggatcacctgaggtcaggagtttgagagcagcctggccaacatggtgaaacctcgtctctactaaaaatacaaaaattagctggcgtggtggcgcacacctgtaatcccagctacgcaggaggtgaggcaggagaatcgcttgaaccgaggaggcagaggttgcagtgagccaagatcgcaccattgcactccagtctgggtgaccgagtgatactctgactccaaaaaataacagtactctctgaacctctgttttcccctccacaaagtgaggagctagagcaggtgacaaaacccaaatgaagaacagccacattggccagcctcccttggcagatgctggcagtggcccacactctcctcaggcacatgggtgctctgctcctctcctctgtacccctctgcagccctgcaccacaccccaatatccctccacctgccccgctatctccctattaccctggggccattctgtgtctcctcccttggtgaagaggagagaacgctccaggagtcttcaaggttttaattaaacatgactccagctaagcagctgtacatattaaaacttttattaaaatcatggctaaggttccacattaatcaggaagccacatctttcctaaatggacaaaattgctggttagatcaccaaaaccagttgagacctcttagttgtcaggttttttcttccctaatgcaaaatccatatgagtcacctttcctgttaggaattaatacatttattaatatttgattggttatgtgattttaagaaaagggcactgggctttgtggaggaatttctgaggactccatggcaaatggaacaactcggcaccaaattagtggcgttggttcatattcttctttgatttatcatcttttccatgctttgaagcacaacagatatgatgggtttgagagtgagcactaaatctccactccctcgctactctgttgacagtagctatttaagagaagcctgatttgtgaggctgaccaggcctgctgcccacctctgtcactgcccgtcaggggattggatttccaacagactttccctttccttccaatctcctccacccacttttaataataggctcatatttcccaggtactttcctgtggccttaaagaatgcggttgcctttgtcttattctcagcctctgagggagtgctattttttttgtgtctgtttcaaagtgggggatgcttagagatctaggtattgactggcccacagtcacaccaactaaagacccagcagccgagactagaatatcccctctggggaggaattcagtatcaggcaaagtttggttggacccctccacaaagggcaatgatgaaagacttcatggaccactttaagagggcagacctcattcaagacatagcaagcagtctgcagtccacagagttaccaggaggctccccacatggtctcagttcttcttatagaagtagggacgtgccctggcctgccaggggaattctcaagtggccagagcccttgccaccatgccaacgctcttgtagagtctattttatcaaaggctattttgcttccagtccctttcagttaggactctccactgggttttatgatcaagtcataaatcctcagtgccactcaaggccctcagaatctggccctgctcacctctctagcttcccctttcctctctccacacacccctacctgccccttgcagccattctgaatctctattgtttcttaaggtgtctttactctcctcaccttctagtcttctgacaaatcactctctcttcagggaacactatcagggaaggaaagatggtttggggaaagagagggtgatttgttttggacatgttgagtgaaggtggcagcaacacatttaggatgtctgtatactacttagaagataggatatgggagaaacaagatattgggacttaagctgtgaaccccagagtcattttcacagacagggcaattgaagctgtcaataggaatatagggagaagtgtgcaggacctaaaaacagagcctctatttgggttagggaaagaaaaatctggccaaaggatatggtagaggtaggtttaactgaaggagatcagaggtgagaggtaagtcacaaacgtgtgcaattgaaagttagggagaggagctaacatttgttgagtgtggagtaggcaccagccctgtattaggtgatgtatgtacatgtggtctgggctcctgggatctaagtggacactcgtttactctcacttcttaaacatggccccagcctcattttctcattatcaagccagcttgccgctactggagcacgacaccttatcttcgtccagagttcattcctatcagtgtccagggttcttctgctttttcccttcagtcctggaattctctcagcttcagaaaacttattccctgtgcctccccttctgagctaccactttatcccaacagacttgtttcattggcttacttagttttaaaatttgtaaaattcttcctttcattgaaaatgttttgttttctctctccgtcttcctctctgttccccctactcccatgtgtttttattgagaggagctctttaagaatgtgaccacatcacagatcaatctcaaactccaataagacggctgggcgcggcggctcacgcctgtaatttcagcactttgggaggccgaggcgggcggatcatgaggtcaggaaatcgagaccatcctgcctaacacggtgaaaccccgtctatactaaaaatacaaaaaattagccgggcgtggtggtgggcgcctgtagtcccagttactcgggaggctgaggcaggacaatggcgtgaacccgggaggcagagcttgcagtgagccgagatcgtgcagctggaccccagcctgggtgacagcgagactctgtctcaaaaaaaaaaaaaaaaaaaaatccagtaagacagcagatctcagtgaagaaaccactgtctgtgtctctgcttccacctgggatcactctgaaaccatgtgcgactttagcaaaagtgtgtttgttttcaaatatctgaagaagaagaaaaaaagtagaaaataatcttaatatttcctaatattgagatattaagctgtgtgtaatgcaaatattcaaatattcgtctacttggcatcacaatgaaaagacatctgggaggaggattgattttcacttttcattcagatgtttttaatcgtgtaaaaagatatttagacgcatgacttcctttccatttaaaattatttcttgtaaataatctattccttctgttccttccttttgcatttttatcagatacttcatttatttcaaccttctttgccccccgccccccaccccccatttttgtttagaaaaatagaggtctcagcttcactgcattcttttgaaagaagtgagaaagagaagagaacccccacacacacccctatagccacactatacccatttctccagtagtgagctagggcatgtttaacaactggctcttcaaaaaagtgaggagacttggctgggtgcagtggctcacacctgtaatcccagcactttcggaggcccaggtggatggatcatgaggtcaggaattcgagaccagcctgaccaacatggtgaaaccccgtgtctactaaaaacacaaaaattagccaagcatggtagtgcacacctgtaattctagctactcaggaggcggaggcaggagaatcgcttgaacccgggaggcagagattgcagtgagccgagattgtgccactacactccagcctgggtgacagagcaaaactccatctcaaaaaaaaaaaaaaaaaaaagtgaggagaccttatttgtactgtttgtctatactcatagtgtaaatgttgccaccatggccactttaagctactgacgtgattttaccgaatgtggagttgggaagagatacacagctcacacccttatatagtatttccaccatacagacacaatatgcatgtaaatacctaacctcaaaaacatagatactagtaaatagttggaaagtgatgagttttgagtgatttattacctttataaaatataatgtagttaattcagaatttttcaacattactactgttgacattttgggcaggataattctttgttttggggggtctgccttgtgattataggatgtttagcagaatctctggcctctacccactagatactagtaaaatcctcagttgtaaaaaccaagaaaacctctccagatattgccaaatgtcccatggagtacaaaatcacccccagtgagaagcactgatttaattgtaagttcgcatattttaataatggctgtatttaacaatcttctttcaaagttcctgaaaatgtcacaatcaactttaaaagctggtactgtcagcttcagctcaacactcacagcattgactatagagaagcttgtcctaagaatacactggtttgccatagtcacataggatatcagaggaagtaaaaagagcaagattctgctatacttctgaactttttggtttctacatttaatgactgtgttcatcacatccctaaatgcagagtgacatctttctttcactgtgttttggttttctttgaattaaagaatgcttggctaacggccaatattcttctcaggtgcatagccctagagttccctctaaggtgactgtgattttctgctctgtcagagttggggacctcctgtaggtccttaggagctttctggaaacaagttttgcagtgggaaatacagggtatagaatgaaaggggacagggtctctaaggcagtgtcaggtagtgatcccggtgaagaggggtcaattccctcattctcagggaaactacgtcctagggtgagaaatcctagtctgcctgcatctcttcactccctgtttctccataggcaatggtcgagcctttaagatactggaaatcatctccagccatccctcttctgggacttttctgacctcctgacatccttatcctttgttcccacaaaatccccaaggccccttcacagaccaatgttacgttggcttcatccaaagctctcaccccacatgccagccaggcactggcgtaacgtaacctgtggactcatttgtctgaactcgtgaggcccagtccatacccctctgtccaatgtatggcaacagaagatattctgatattggtggtatttgcttcaggccatgtgctagtttcttagggctgccacaacaaatgaccgcaaactgggtggcttaaaacagcagaaatgtattatctcgcagctctggaggccagcgtcaagttgcagcggggccattctccctcccaagactccagggagaattcattcttgcctcttccagttctggtggttcctggagctccttgacttgcagaaggactccaagctccttcctcatatgtatgtcttccctgggtctcaaatctcttctcctgcctctctttggatttacagtccatgtaagcttaattacatctgcaaagacgctgttaccacacaaggtctcccttgcaggtaccagcggttaggactagtacatatctttctgagggacactgtttaacacactatagggatattaggagaagggttatttctctagtttcataagttattcaacttatctgacctcccaacatgaaaactagccaggaagtgaggagaaggaggctttgtggcctccagcatccctcttcccaggtagagggaaagaataaacaactctttcactcccttctcccaccaagtttgtgccccaagagctcaggcgagagggatactttgcaactccaagcagcctgcttgagccagcatggactaaggagcagagagggctggtgtggtcagctcaggcctgatctgagagaagcagagagctggaccccagagcacacagggctttgtgaccagctcctcggagtggcaatgagtcaggtgatgtggctgggtctcaggctagggtgggcctggtggtattccaggaacaaaggatgaggattaagaggaatatgagagtcagacccgcagggagcagaaaggtgctctgggacccgctgagtaccccagaagccatcagctgctggcgactcagggtcctgccactgcccaactctcactccatcccccaggcccctccggaagcactgtcatctggattttggggagctggttctccagtgacaatacccccagccttcaatgtgggtagccttgactttgtacctgagatagagagtgatcttaagattggcaacaagggatctcaagccgaaaagaataaagacggactcatgagaaagacgacagaaagagtaaaacccagaatgaactcaggtgctgaaagatgccagtgacggcccagaaggtctgtctcagctctgacgacaccgagaattagagggcgcttctgccactcagggatgatgatgtaatctacgtgaccaggacttcatacgttgattatttttgtaaaaactttctttttccttccttgtcttaccaggccccctctctcctttcatttctctctcgttgttagccctgctgtcactccttgcctccctcttctctctgacctttagtgagaaaaattcaaaatgccatcttagagctctatgtttatttccatctctttaaattctggcagagcccagccttcacctgggctcctctgacgttttatattcttccctctttttagtcatcagccttaatgtttcacggccctggggtgtgactggggaggtggccatgcccacttgcctacgtccagccctctgtcttgctttcggtgcttcccttgtttaccatcctggctgtggctgcccggatgcttccaaaagccaagtagtctttaagatcccaaattcaagagcagctttaaatctttgaacttctttccagggactaaaaggaaagaatgaagaatttagttcgtcagaatgaggaagtctgaaggacctgataaatgaaattggtttagacagaactggtgttttgttttaatatgggggtactgtgttgaagaaaaaaaaattattccatgattcttgctgaagcatggtaagacttcgttcaggaccatcatgatagggaaaggggccactgcagtgggattttttttttttttttttttttttttttttgagacggagtctcgctgtgtctcccaggttggagtgcggtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggcctgcagtgggatttttgcagggagggagagagatgaggctcaactccaaatatagcatgagcaggtgggaatacatagccaagaagcaggatgggggtaagaggatggaaaattccaaggaggaaacatcacgggtaatggggggattctggctaaagtgacctcacaggattcttgctgaagacaggccaagatgatcagttattacctggggcctggtggaagatgagaaaccttatcagatatctagggtggagggtttttgctgaactgacttagcaagtttcttaataacactgggttttataaacgaggacacagacgtgcctaggagaaggttcaggaacctcactaaagtttaatctggcaaaaaatctttgtcaactgaacgtgaacttgagtttgaaggtaaaaaatttttttaacctttaaaaatggtcaactgaaaacaagccgcggaaccatgcatgatttgggtagaccgttgtagagtaattaatgcaatacaaattagtgacccgttttcaatcaattaaaatataataaagctaccaataacactatgttcagaagaatgttcagagaaattaaatagttgcgtgattaggaatttatttgttcttcttagtgtgcctctggaagaattatgcatatccgttcccatggccctggagatgtattcaagtgttggctggtggagaagttcatttgatgacaagccagacaaactagctttggctgtgggtgggcagtgtcccaggggtgactttcccctaatatgctcaatagtttcttattccctggcacacagagagcttgacacaatgacctccaaagcccttttagaatggcaatttgacaagcgtgctagaggggacttcactgtttactttcctttctgccaaagtgcttccacctggcacagggatacccactcccttggcagctgattctgacttatgaaagtactttatgccaggtctctaaatgttcattagattcttttgatctaggtaatagcattctgaaaatacagttactcatccataaaatggggatagtgtaacttcccgagctgtaaccatgaacgagaaggccccaactctatacaatagcagtggagttagccaatgattttggatattgttgtccggtcagagcctaaagacagcaggctgtgagtgtttgaggtttctctgagtgtgtcatagcaaaccctgcaaattttgggacccaaaagacctgccttatggttctagctctgctgttcataagctgtacaaacttgaggaagcttgttggtctctctgccctcgatttcatcactgtacaaactcaggaccaccacacttttcctgaacctgtccttgcagggttgttgtgaagatttttccccatgaggtaggactagagatcctccaacttctcctgtcacgggtcacacagctctggtatattcacggcaatttgtcctgcctgtgaccctcacctgttagtcatcttgcagcagaccccatctcctacctggagaaggcaaatgcaagtgagggagaatagcattattatagcaacagcatcaaatcttctctaacttataaacaggcataaatcacctgcaagctttggtagtttattatcagtagcaaattacttatgatacatctcacctatcatcgcttgctcggtggttgaacgctgcagagatgataaggtttctcccacctctaaagctctcagacctcatgtgtgtgttcaggctatataaatgtaaatgttgttgatgatgatgatacccaatgtatgcagagaaccagcccccggaggggagcgaggggcttgttcaccagtacccaatgcattcagtaaggtgctgaaacagcacaaggcagctacaatttgcaggccttgtctggcccgcaagttaagaatggtttttacattttaaatggtggaaaaacagtcaaaagaagaaaactattttgtgacacatgaacattatatgaaattcaaatgtctgtgaccataaatgaagtttagttaggaaatagccaaactcatttgcttacatattgtctgtggccaccttctccacaatggcaaagttaagtagttgcaacaaagcctgtctgtctcacaaagcataaaatatttactatctggtcctttatagaaaaagtttgctaacctctgggatagcatgtgactcaccttaccacaatccccaaatctagagacaaaaagagagcttaatttctttctcggccaggtgcggtggctcatgtctgtaatctcaacactttgggaggccaaggagggtggatcgcttgatgtcaggagttcgaaaccagcctgaccaacatggcaaaaccccatctctactaaaaatacaaaaattagccaggcatggtggtgggtgcctgtaatcccagctactcgggaggctgagacgcaagaatcgcttgaacctggtgggtgggggttgcaatgagctgagatgtgccacttcacttcagcctgggcgacagagtgagactctatctcaaaaataaaaataaaaataaaaaatttttctctcatctctttttccatgaatagctaggataatgtataatttatggtctcagtggagacgttcttgagagtgaaaggggtcactgcataaacggacacagtcccagaaaagctgggatgcaagatcaatctacttaaaatccttagtgatagcaaagcaaagtaaatctgtccaggatggggacagaaattcctgttggcccaaactctgatgatgcattctctggcttcctgaactagaagaggcatgtcttggcccaagaaccaagaggagggttagatgcagggaaagttggccttccacatgctacagagctctactctacccacctctttcccctgaaccaggccttcactgttaaatcaatattttgatatttctatatgttgttgcttttagagggataagctacatttttttaatttttatttttagctcataaaatattgaatacaacataaacacagtctctcatctttatttgtttttggaagtttactaaaactctcccctcacccgggctcttgttatctgtatgggagatcaggatcgaaagaagtcaaaggaagaagtgaagctatggacagttatgcattttctataaaaccaaatgcaaaatgctaagtattagctccaggcgaatgagttgacacattagcatgtgacttgaactaaaaagagaagggttttttaggggcctggacctttggatcctccaactagttcacctcaggggggaaaacaaaaattttgatttactcttgtaggggcagaagaagaagtgatctctcagaatagcaaaggctatttcaccttgagctttatacttctttgtgaaatcaatgcttttgagttgtgcttaaaaataagcttacagcctatgccagtcatgaaagacagatgttatttgtatgggagatcaggactgaaagaagtcaaaggaagaagtgaagctgcttgaaagacatcaggcaatagccaggaatctcagatctgctgcaccagaagaccagggacttggtgtctgtgcccaagtctaaaacatgagaatatcctacccctcccccaaggggaaatatattagcatccctccagttgccctggggagtagtctaactggtcacccaagagaaaggccctaggctaactttcaggcaagagtagggaggtgttggtggaagtgattcaggcttcatttgcattgaggggcaggtaagggtacacccacctcatcctactagattcccccatctcagtgctcctccgtcctggaactggtcccaggagtctgggaatctcagctaaacatcttcaaaaataatcacccttaattgtgggaactgactagaggacttaactgctcaggctttagttttttattaattggaatctggtagaaagaaaagggatatatctataaaggtgaaatttgagtcctgttcctggatgttgaaagtgttttatatattttggtaggtagcaatggggagatggggctttctgattcacttccaatcacactgcacaagttgtcgcctactttactttctctagagtccagcctaaatgagtgttgaaagtgttcctatttcccaggtagataacaggaccactatcccagaggagcttggagataaccaatattaatatattgtcatgggcctaggccttgagcctgcaacagaagcccaaaatacaccaagattaattctagattttaactaaatgtagttaaatttaaaagatcagagcatttttttgagacctaaaagataatatatgtggatagttatttcattctcaaatgtagataagaattaaattgaacaaatctgtcgagatgattacataagaattaaaaatcctatagttaaaaaacttaacaaaatggaaacacaagcatattttccataaatacataagaaaatagtcatcgtatttaatatatgtatgaaagcctcacattaaaaaaaaaaatgttaatatcccccccaaaaaaatgggcaactgatatgaagcaacaattcaaagaagaatacttaaaaaagattaataaaaggatgaaaaatgattgcaattgctggtattcaaagatgcaaattaaaaaacaaaccattctctactacaaaatggcgaaggttttaactgtaataacacaataatgccaatgaggttgtgatgaaataggcatgctttttatgctgttagcaagaacataaacatattttacaactgtaaagcagttgtataatattcatcaaaagtattaaaaatgttatgtattttaaactactaattctcatagtagttatgtatcttaggatacgtattaagatacatatgtatcttaggataataattaaaaacttgaacaaaaaatttctagaaagattttttaatacaacattatttataatagaaaaaaataccaaagcaaaaccctgagaagatgctaaaagcccccaaatgagaaaatggtaaatatagagaatatttaatattatagaaaaatgctcaggatattttgtggaaaaatcaagataaaaatttgtatatggtatattattttaattttgtaaaaacaattgacagggtgggcacagtggctcacgcgggtgatctcagcaccttgggaggccgaggcaggtggatcacctgaggtcaggagttcaagaccagtctgaccaacatggcgaaacaccatctctactaaaaatataaaaaaatagccaggtgtggtggcacgcacctgttttcccagctacttgggaagctgaggcatgagaatcacttgaacccaggaggtggaggttgtggtgagccgaaattgtgccattgcactccagcttgggtgacaagagcaagactctgtctcaaaaaaatagtaataatagctgacagaaaatacattgaaatattaactgcataactttctctggtgtttgaattgcaattgacttttactttcttctttgcatcatcacctaaagtaaatgttaaaaattttttaattatacatttatattttgccttattctaaaaaagaatatagggtttaaaactatcaataattgagcaacataaaataaatttaaaataattaagaaagatagaggagaaaacatagataagcaagttactatgaaccttagaatgtccttaatacaaaaaaccatgccatgcaatttacctgagagaggaagccacacgtttggctgtgggcctcctaagcagcacacacgaagcaaagcacacgaagtgctttccattataaaattcacagtttagctaaagcaaaacaaaccagctgcttaacaaaaatgtatgtggtctgaaactatgaccagagagaaatcttttatatggatccttaaagagacaccaatactcaacagcatctgaacaatcattgtaacaatgcatttatgtggcattgcttacaatgacttttcaaatacaactgatgtcaccatgctcaggtgcaaaccagaaaggcattctgatcacttggcaaaatccagggctagactccagaacaccgaaccagccattctatagaaggagttctgcaggtcctggagtttctctgtgaagaaaagtattcctgtgagtgtgagactgccgatgatgagggaggaagaagtgaagggcagggccttgaatagtcctattttttggatatcttgtttggtattcaagcaagtgtttccatggtcacacggatgtgtggatgcctgcatactctgtgtgcctgtctgagagtcacagggtatgttaccaaatcagacagtgttcaatacaggcctgctccaatttatttgactaatttcactgcaaaattcctgttaagatccagatgaaccaaccattaacttttctcagattttatttgggaaaaatgtccaaggaacacgcattgcctttaaaattaggggaacatcgtttaacaagtaataaatgaggagggttcctatcatggaatgttcatggactccctgcatccttgcccttcagtaaatcttgctagatttaactcaaagatgtttcctagggtctccttctcatagaggcccccctcagttctggtaatttttttttagcagcctgggtatttcagggggctctcttgaacaccccctgacttaccctaccccatttggcttttgcctttagccttctgctcccttatgctccagggctaagatccaagaaagacagaagctaattgtttttgttttatgccagggaaagagtgttcaagatgcagagctggagaaagtggtgactgttgatagacacagagtaaataaatcaggcctctaattaaatttacatgatacataaataggttgtctcatttatttagtaaacaaatttaggtagataatgagatttccactgaagactggtcattgccccagaggcatatgccggctacttaccctgttaacatcccaggttttgtgtagaatagcttatctggttcatcaggtgagtgtgactgcaagagatgggacaaatgacaaacagcaaggaagagaggtcactggtacaggggactgtccttctagatagttctcttagggagggcagaagcagggatctcatggtaactggaacaggaagagaacagatggagcatgtttatcttgatattaaaagtccagaaactgagatcaagagaggttggaattagaatgaggatgcatctattgtgttctttgtgaagggttttgctttgacttaggggtctagccaggagttcggttgcattggggaagctctcttgaattaacagagacaggctgcaaaattccccattgaccagtggtgtggtcttgggcaaatcatctggtatctgtatgactaacagagactaataatgatgaaaggattgtcaaacagttatgaggtttgaaatgccttgcaaattataaagcatgatgcaatgtttagttttacagtaatattatgtaaataacagcagaagcaaagtgtagtggaaggaacagtttctctggattaagagtgctgggtttgggctgggcatggtgactcacacctgtagtcccagcactctgggaggctgaggcaggtggatcacctgaggttaggagtttgagaccagcctggccaacatggcaaaatcccatctttactaaaaaaaacaaaaaaacaaaaaacaaaagttagccaggcatggtggcacatgcctgtagtcccagctacttgggaggctgaggcaggctaaaggcttgaacccaggaggtggaggttgcagtgagctgagatcatactaccacactccagagtgggtaaaaaagcaagactctatctcaatagaaaaaaaaaaaaaaaggagtgctgggtttgaattctgacttttgttcttttccttgtgtgaagttgacactggaaaaaaattctagttctctctggttccgtctctgtctctttctctgcatctgtattttatactctctctgtctctctcacacttggtctctgtctatgaaacacgtgtgataacttcttggaaaggaatcttgatgccaggctttggaagatcctgttcctcggaatgactgtgcaggtaaatgttctttagagcatcaacacagaaactaacaaaatgaagtcacatcacagtgtgcctttaatctgcaaatgccccgcagaagcctagcaggcgtaagacaagtaagaatgtccaggacatggtatctgaacaatctgtcacatccatggcactcacccaatcccgagaccccaattttaggttctcaattatcagactggtcctatgagctcctggctcaaattccctcccaggccctgttactgagatactgaacaaaatgagattgtgcctttagaagcagttagaaggaagtgagatacccattcttgtaggattttgggtggggtttctgagtactattcaaatatcttcctcctctatgactgcctgagcaggaaggccgtttccctctgctgcacctgcatggtgctctgtttctgtcactcataggcactcatcctcttcttccctccagaagtggctctatctaggcagatctcccttctcatgaagactgagcaactcaaggtcagggcttaagtgggagatatttctttgtcttcatacactggccccatgctttgtacagtgaaggcccaataaatgcttgttgaatgaatgctcgacttgagtctgcacgcaaggaaggggtggaggcaggattgtgccatggccacctcctgcagcctactctgcagaggcaccacccatgcccagtcttcccttagtatcatcctttctacatgtttctctctgcctaagaggtaaggaaacaaggcaggatggacatttaagccatcactgagcaaaaactcagcagaggcaaatgcccagtctttccaatttggaaagaaagaagtaagaagagagaagaaaggaactccttcctgttttggggatccagagggctgaggtccctcactgccctggtcatctaggatggtcaccatctcctggagctctgggtcttggtgcaagcaactcccacttctttagccaagacgggcaatacaggcctcaaggcgcccaggccacacttcaccttcccagcctcctccctccagtgcactgacagcagggagaggagagcagagctggtgggaagtggatatgacgaagtggtcctaggaggtgttcccctggctctggggctaggggcgggttccaccaggtgtggccctccctttgagcagctgctctgcacgggctctgctcatgctttgactcttttattttattttattttatttgagatggatcctcactctgtcgcccaggctggagtgcagtggcacaatctcggctcactgcaacctccacctcccgggttcaagcgattctcctgcctcagcctcccgagcagctgggactataggcgcgtgtcaccacaccaagctaatttttgtatttttagtagagatggggtttcaccatgttggccaggatggtctcgatctcttgatctcgtgatccgcccaccttggcctcccaaagtgctgggattataggcatgagccaccatgcctggccactttgtctctatttctgtctctgaaacatgtgtgacaacttcttggaaaggaatcttgatgccaggctttggcagaaccacatggtatggccatagagatgggcagaagatcggaccttgtggaaagaggcaccccatgtccacccacactgactcatccttgcttcctagccctcaacacttctttctgcctgcctgagacataaggaaactacaacaggaagggcataggagccgtccctcagcaaaaccccatagagctgaccactgctgaacctgtggcataagcgtcagcccctctgactccccgccattgggcagcaggatggcataaatagccccaaaccacgtcagggcccgtttttgttcaagctgaaccaaactgtcatctggatggcaattttccgctccacatctgtttagcgtaatttagaaatcacagcccttgcacctacatgatcggtgccacatgttgctcatcttccttattatcccaaattaaagtgttgcctggtatctgggttttctgcatggactgtaataacggggctctaatctgacacccagtcaaactgggagaaagcagattgaatcaaatgggggttatgtcaaccggagacgtgtgctgtggctgggcctgaaatcctacgctttggttataaggttgctcagatgccagcggtggccttgcggtttggctcctgtgcattacagagaaagggggagcgggagaggacaccgaagcgagtgcatctgggcttcattagtggcaatgtaatttacaaaaggcagcttttcagatgttgggataattagcaggctgttatcaaggtagtgcacggtaatcacgggttgacatgagcaatccatgctgggtgagataaatgggtttgactggcagggcagcggttggactttcataaaaaacaaattggattttttttcctgtggcttaatataagaatcatgtggacatatgcataaaaccgacacagtagcaaaaatccctggcagaaagaaaatgccactgtgctgggtctcagagccaatttctgcgttataaattctgtggctgtttgggcagtggttgaaactggggtgagtgggttgaggaggagaaagcaatgcagggacctctcagcccaaccccagcataaatcacagaataatggacaagtaatttaatactgttctgaagcctcagagtgaatcattgcttttcctacaatgagtctgggttctggggggtgcagaaccttaagctgttgactcctagaattacgccctctttgggagctgtatatcggtgtgcccagcttcgtcaagactgaagtattttgctgagggggtctttcaaccttccctctacatatccggcatctgaagcaaatgaaacagctctcaatctgatgagttgacagtttttcaaatctggcatgtagtgggtgctcttggagaagcctcaggatggctcatatatgatgagttagttcccagagcgtagaggaaaagagcaaaatatcaccaaagtgtatagaggacatcgctgaggacatctgggaggctgtcagggatttctttgcatataacaatgcacataaaaatcaaagtctagctgaacatttgctatcacatcattcccatgtggataagaatttcattttgttgaagttcaaattaaataagccatggggatctttaaggcctctgaagcttgtgggatacaaaggaagagcggatactatttttcatggcaagttgatagaaagacagctattggtgcaggaataagttcatctttaaagatcagaaagagcctggaacgctaaagctggaacggaacttaggcataaaccatccataggtgaggcaagtcaaagacaaaattgctaacacaaggtcacacggcaaattggccacagtgtcaaggctatggccctgggctttgggcattttctgttgtgctacttggtgccctgtggatttccagacccattcagcagggctacctagagatgctgaagaaagggcctggcaagccaggtgctctccagaacatcaaagtgcagatagctagtacttcttcaagagtgtgcattctcctgctgacattgctttttagactttctccctccccattcagcagtccatgccttggcttcctggcatcaccagccaggaaagcacagagacagtgctcagattgtctgaagggcaggtccaggggtggggagaagagctggactccagggtagatgcagtcccaggctgggatctgcactaaccagcgggtgaccttgggcaagtctcttcactgctctggcccttagactcctttgactctgaaacgtggacatgaaatcaaccatctctgtggcttttgaggcagtttttgctttgctgcagtggaaccctttattccgggtgaccccttcatcatcacatacccctgcaagaaagaaagagacagggtatggtggttctagttgaagacaaggaagaaagccagagaatgccttcacatgggagcccccctacccccaaacaggccctgagggccctcctcaagcttaggactccacagagttaggaaaacactggaataaccatcctcaaagaccctttcggcatcagcacttcatgattctattaacagcctggagtcaggtgtccagacagagactatgtaaattagggcaccataccctgcaacctctccctgagctacagtattagtctgttctcatgctgctgataaagacatacctgagactgggcaatttacaaaagaaagaggtttaatggacttacagctccagatggctggggaggcctcacaattatggtgaaaggcaaggaggggcaagtcatgtcttacatgaacagcagcaggcaaaaagagagcttgtgtagggaaactcgtttttaaaaccatcagatctcgtgagacttattcactatcatgagaacagcatgggaaaggcccaccccatgattcagttatctcccactgggtccctcccataacacgtgggaattcaagatgcgatttgggtggggacacagccaaaccctatcagttagtgtagatcaagattcactcttcttcctctttacctagaggaaagagcccaatgcaactagggggtgccaccctgggcctgccagtgccgccacccctcaactttcccctgacctaagaaacagtctggcttcgaggattgaagaccatatcctgcaaaaagacaggtcttgggtgtctgacgaattggcttatagtgtccatttaggttgccagaaaagattcatcaactgtcagctcatgtgagaacgagagcagagattcaccaagcatgtgcttttgtctcacatcagtgttttaggccatctgggagacaaagatgtggtgaggagccagtcactcctgtgtttgcagagctgggggaggttgcacttgctagaaggatggtcccatgatgggcagtgatgcctagaactgtagcatcccctggggcagggccctcatctcctttttctacctttactaatcctttatcgtcatggccacagatctcctccgtgtagacttaccggtcccatcccttcccatgcatctattattatctgttatttaaggcaattagacacattcctaccaccttcccaccattcagactgctcgttaaatttctttttgccttttgtcacacctgagggaggggaggaagtgactgagcagagcatacaaggaccatgacagatgtcatctgctttaagcgtatctgaagtaggcatctttatttacttccatatgaagaaactgaggctcagaagggtaaaatgactcaaagagagtgaagggcaggccaaagatctgaacccaaacaccccagagtttattttacaaacatccaatgccacttcctgcgagaatgtgggtgaagtcttgggctcccgaggcgggtgccatgcatgggctgacaggcatctaagaagttctccagagcagcggtctccaacctttttggcactggggactggtttcgtggaagatgatttttccacagaccaggggtgcagagtggtttcaggatgattcatgcacattccaattattgtgcattttatttctattatcattatatcataatatgtaatgaaataattatacaattcaccataatgtagaattggtggaagccctgagcttgttttcctgcaactagatggtcccatctgggggtggtgggagacagtgatggatcatcaggcattagattctcataaggagcatgcaacctagatcccccgaatgtgcagtttactgtagggtttgcactcctatgagaatctaatgcagccactgatctgacaggaggtggagctcaggcggtgatgtgagcaatggggactggctgtaaatacagatgtagcttcgctcactcacccaccactcacctcctcctggatggtctgtggccctgggggttggggacctgtgctccagaggacctgctagcatggctgtcagaggcatctgcaatcagcatggggcttcactgagagcagtcatcaggcagagaaccgagctgaacagggagggacaaatgtcaacagagcacctgctgaggacatgggccctgcccttaccaagttggcattgacagttgagggcatttgccaagttagcctgcagttggaaggcagtgtgcatggtggtaggaaggaaaatgtagagcaacacccagacgggccggcagcatggccctagaggaggcaggaaggagaggctcatggttctgctcctgatctctgggagcttaatgggcagtggagttgttgacaagcacacttgtaagccagactatttcttaatgccttgtgattatttagggatttgcttttcagcacatcctagctctctgcttcattcatttcttagtctcaaaaatgtgtctctgtttcacttcaaatgacctagagcagccaatcagtcagccccagttcctgactgcaccccgtgcacccactggctaattatgaaatgggataactgcaggctcttgcaggttcttccttattccagcttcaggagcacataggcacatcttaactgggaggctcaggaggtgcacagtatgctctcatataaacacatttcctctgcatcaacctctggtgttcagaatatgcctttcatgagcccatcagccacacccctgctgcaaagccccctggactccactctgttggagcatttggcaaccccagcagacttgaccaaaagaaacaccatgctggggccacagcactgcagaagagcaatcttctgcttagaaactttccaaaggactgggaactcacttatctgccggcaaaattgccagcttgggaattcagcactgcttctctgcaaaatcaggcgctgaattaccctgcacttaacaaatggttgccctgctctcctaaagctgccaacacaaattgaattgtattttttcattggtgtatatagtgggtgtgtgctagagccagcactaatttccccctagcaagataaatgcactgacccgagccttcgtgctttattctgtctcattctagcaaattaaaatgtcacagagctatagccatcctttaggagactgggtcaggtggggatgagggaggttgcagtgggggtaggaagcctatcaattggtctcctgcctcagctgcaacttagataactaaagagaataaaaacagatgaaacctggtgaaaacattcgcagctttccataaaataagtctgtagaaggccgtgtcaatggaatctcgcaagaagcaaaatgtattatttttggcagttttcttcagggtaatttttacattgctggtgtcctctcttggatttccacctccccccgcaacaccgttcacccttataaccaaccacaatcaatttggtttaattgagttctatgaaaattttcacctagagaggccacttcatgaatcaaagttcatcagcatacaacgttgaggcaatcagaaatagagtctgatttagagaggctctcacagggacttgcaggaggaaacggggctgtgtttgcagctggagtgccgctggttgtgcctgcctgaattctctgaagttgccgtgcaggtattaataatgtaacacctggtttcacatgtgtttttctggcagtcatctccccagcatcaaagggcacttcagcaggctcaccttcatcctttttggaaagggtgtgtgtgggactgtgctgcgtcccattttccagagcagaaaatgcgggcttagaagaacctccccaagtacctaagcagtagctgagagaagagttcagcacggcctcccctcctcatcagcaaaaggtagaaacaccaacccgcaggaggccctgcctcaaagcaagtctagggaacttgtacccattcctgcctgcacgcccagaggtcaagcttttctcaccaaatcttcattaacaaggtcctgccaagaggcgcttcataccagaagcagtcagagagatgctgtttggaagctgaaatatgagtctttctcagacatttcaacggtttatagggccggcaggaccaaacatataaaatcaagtctgtcccagaaaattcaagctaaatggtagccaacccatgggggcttaaaatcaaaagcagagaacaccagcacagacaggtgggaagaggcccatgttggtgatacttaaccccctcatgtacgtttcggtttagaaagagccttcttattcaggatctccctcgccgtcctggaaggtggatggagaagtggtgtcatggccctgctcagccagcaagaagcccaggcttagggagatgcagtggtaagagcaaatcttttttgcacagctgggatccaaacacagatctgctgacaccagagccatgctctaaccactgcaccacagtccctcaccataccagcttgcatgcagtgggacttacttgttctgctccggcatcagtaaatgctgcaaggacatttttttttttatttttttcagatagggggttctggccaaggactctcctccctcgaggtctttgtacttggtattctcactacctgaaattctacccactatatatccatctctctctcctttttattgtgcaggtctctgctcaaatgtcagctcatcagtgagatcttttcttcagtgagatcttttcttaccacccacccatgcccatcacattccattttcccttattgcatgaatcagtctttatttgtatactgtctgtttccttcctgtgagtgtagtcatgagcactgacaccttgtcatgtttgttgttctattcccactgtcaaggttaggagttggctgtttttgtaaaaggcctgatagtaaatattttaggttttgtggcccgcacgctctctgttgcagctgttaaactctgccatagtagtacgaataatacatgaatgatacgtgtatgaatgggcctgacggtgttccagtgaaattttggtggacactgaagtttgaatttcatataatttttacatgtcacctgggcaatagagtgagatcctgtctcaaaaaattttttttacattttaagaaatagtcttcttttgtttgcttttaaacccatttacaaatgcaaaagataagcatataacattcttacccatgggctgtacaaaaacaggtgttagactggatttggccttgatgccatactttgcagacggacctctgatccaaattagtggctggcacagagcaggtgcctagtaaataattgttgaaggagtgaccaaaccaacgcataactatatcatgaaattgcatcaagcaacaggtaatcagccatcaggtgtttatggagcagctgggtgctctgagggatgctctagaagtcagatccagcccagttctcagggagccacagtcttgttttacaagtaaggggagggagagaaaggagggagctgtagaagttcatcaggaaaagagaagccaggcagatatcctagtttccctgcagcttacccagaaattgagttcccttggtaaaaactgctttggaactagagacgggatggtgagctcagaagccagggcctgaggaggacagtgttgtcttgggggcctggtgctccagagagacaccacagaatgcttgccacagagatgcatggaccaccacaatcccgctgtccagggctgcgtgaaggaatgcactggacatagtggggaggggaggaagaggcccctcctacagactgaaggaatgggtggatgaggggcattttcccaagacaaaatatttgagagaagtcttcattcatctgttcagctcccatgttttgagaggcgtggggattggagctgaagaacaggcaggcatggtcctcacctttaagggatgacagtagaaaggggatcatagacgctaaaggttattgtgttaaatttgtgggaggtgctctggtgaagaaatagaggctgctatgagaatataataaccacccagataggcgccacaaaggggatggattttcctggcacacaaggtcaggggggcataccaggcatgcagggcaagtgacaagtcgccatggcacaagagagccaggcgtgctcaggaactgagccatcagtatgaccagactgcaagaagtgtgctgcttccctaggaccttgcttactaagctgaggagtttgagttcaatcctgaagtctgaaacgtttcatttaaacggtggccgaccatgtttctgaatggcccacaacgctgacgtctccttccagggctcaagacctctccacaaatatgcctcacctggcaatttccaagaaaagaaatcttcataactaattcaggataaacaaatccaaaatggctttaagtgacatcagcagagagaccctcaagtgccacaatttggaaatgatactcaacacaggccttagattcttgaaaatgtgacttgacttcccaccttgcaggatacaaagttaagcgttgcctccagggagctgagctcctttccctaacattggttcttggtcttttcatccctcagtctagcaaggctcagcccattcttcacctgggctttctttgtgtttgcagatattctcatggtattagtctgttctcacactgctataaaggtacttgccagtggggtgctctagttcacacctgtaatcccagcactttgggaggccgaggcaggtggatcacgaggtcaggagttcgagaccagcctggccaatatggtgaaacccgtttctactaaaaatacaaaaatgagctaggcacggtggtgcacacctgtagtctgagctactcaggaggctgaggcagaagaatcgcttgaacccaggagacggaggttgcagtgagccaagagcatgccactgcactctagcctgggcgacaaaatgagacaacatctcaaaaaaaaaaaaaaaaaaaaaaaaaaaaaaaagatatgagccaagactaggtaatttataaaggaaagaggtttaattgactcacagttccacatggctggggaggcctcaggaaacttagaatcatggcagaaagcaaaggggaaacaaggatgttcttcacaatagcaggggaaatgccagattcttataaaaccatcagatcttgtgagaactcactatcacaagaacagcacaggggaaacttcccccatgatccaatcacctcctcccttgacacgtggggattgcaggtccctccctcgacatgtggggattacaattggagatgagatttgggtggggacacagaaccaaaccacatcactagtctataaactacctctgtgtgtggctgagcccctctctgtaggtctctaggtgcccctgagagtttatctctgacttctttgtggccccttaggtgtccttagctctctctgcaaagctgttcattttcatctttcacaaacagggagagagaacacatggtaaggtgccccctccactatctccctccaggactgtgggctcttcctatgtttctttatgtctatttttctctcctccaactctttcttccccctcctttttctccttcctttctccctgagtctctgctctgtaattatccataatataaacagattttattatttgttataagtatttgaaaagattttgtgtttcctgcttctagtttaaaaggctgctgagagaacagtgtctaattcctttctcagaaacaggtaaataaaagttttgctttgctgatgagccctggttggataaaatgttcgccatctgcactctgcacaaggaagccctctgccagggaaccctgctttcatcaaaatcactcctgaccagccagctttactgtcgagagagcgaaacgtctaaaagagataagctatgcccgtcagaggctttgaggatccttgccctggagctggcatttaacaagttctaagagagagaaatgttctcccaggactcagcctcagagcctgctcctgcagaccctgtttctatcttagggtgagaccctgtgtctcaggctgtttgacctttacaatccctcacaatccagaatctctgaacactttctgttctaatgtttccctcttcccatgcagctctcccagaattttaacattcttgagcactgtcggtcctacctgggcacacctgccaagcttccttggaaaacaggccctaaaaattaagccaacttcataggcacagatgactacatacacacttatcaactcttttcctaaaacatcatcttccaagtccagtgtctttgtgacatccggagcattgatcgctcctatttctttatcttctctttctttttagaaatccattagaatcctaggttttaatagttgtttccttgatataaggagtttaattgtgcagctcttagcatgccctagagagtctaatgagaaataaataatcctaagtagcctcccttaggaatgaaggataaactctacccagaggctctgttgttaaggagactttgctagttgtttccacagtgttaggctactccccaattaagcaggtggttccttcaggcctggggtcatttcttatcatttcttatcctactagggtgttccctttcctctggagctctgagcctgggcaagcaggacctgagctggaggctctgtgatcagcaagcttataatgcagaggagggaagggggacaacctggaacccaggttcttcccctcctagagtggatgtggggttccagggacccctgaagaactttcaactggaaagcagggatccctgcttgcccaggatctgtgctagggactgaagggaataccctagtagaataatcatgttagtcagttgatggtggaatcagcaccaccccaccagagccctctggtgccctttgattgtttgagtgatggccaagaaaccctatcagttttcatgtgctgccacgtcctcatctgtaaaaggagacactgtctctggacctcactagggggggggaagaaaagggaaagaaagtcacatttactgggcatgttctttgagtcatattctgtgttaggtactttcccattcattattacccacctacaaggtacatgtaagtatccaacccattctatagacaaggaaactgagattaagtgatttacccaagtaatgcattattagggatacagatgggattacttggctatgtaaggatgcagaatgtcactggaagggctcactaggtgttaatcattgctgctgctgctgctgctcctgctgcagctgttgctgtaattatagaaagtcaggctatttgatttccaaccccatgctctaagggtgaatgaaaggaaacttgcaaaattccttgagacgggcaggatgatgagcctcacaggttggataaattcaagcagtttaagccataggcaggttcaagttaacagtcagtgcccagagggcttgctggtggggcaatgtggcatgtgattggaagccctctgggtgctcagtctctggccttcctctttggatggaaacaggggtactgcagagagccaaggctaaggtctgaaaagaaagactcatcccccgccctgtcccacccaaggtaaaaggtggagagacccagcataactttagggagtgcactgtcagcccctcctacagaccatacacaagggtcagttcaaagtgctgtcattgcccatggcgacaccactgccaagcgattgtttttccacctagtcccactgagaaaacactggcaacacacagcatctttatagatgacaaaacaggaccccaaaggggagaagagcttctctcagattccagttagttctttccccttctttgaccacctctgctaaccgaacccacacccatgctttctcttccttcctgcactttggaggttctgcagttagtgagcttacagagcaggggagggaagggagacaatctggtacccaggtttttccccttctggagtgggtgtggagttccagggacccctaaagaactctcgacttgaaaagcctgccctccctacactttgagtcacccacctgaaagcacactagacatttgaattcctgactgcagccggctctcaattaggttttcactgccccttgtcagttccctagctagatttcggcagtgacacttgttgtagccactacagaatgtggcaatggaaagaaaaaatgtcactatgccgttgtcaaaagaggaaaggcactctgttcaatcaactgtgagagagattgaattatttatagtgcctttgtcagtcactgcaaaaggtaatttcattgcttgaattttaagtttttcattaattaaccactttttcagttcagtgctccgcagccaggcagaaacccactgcagagccatttctgaagagggcgggggccctgctgctcccagtgacatatggatgtctctgtgtttttgcttttctgcagtcacttttgctgtgtgctggtacagatattggatgtttcatttaaggctcagagtctcacccaaactgtctgcaatttaatatatctcagtatatacgctggtaaatcatctctgtgtcatttctctcaatgttctgttattaaagtccatttttcatggtaaaatattcctccaagagatggcacaaggtacacacatccccaagcctagtatttaacgctaataggctgagctttctctgaaactaaacttggaattgagaaaatatagcagaatgaatcaggaaaatgctttcttagaaacggaatgggatttagactagaaagggagttcagaagaaagcttacattttacctgaactgtccagataattgctttattttttttcttctcttggagagtggaaacgtggccagacgcaccttgggaatggtttcggggagtctgtgcaatgataccccaaaaggagcaagcatgcaaagtttataaaactttttcaggtgaagcaataagttaatgatattgtgtgattgtgaacctcctgtctgaaggcaagagtcttccaaatattacccctgctagaaacagagagtagacaaaagctgtgtcaattcaagagaatacttgaatacgtactaagtgccaagcacaggacaggtctggggatgtggagaatatggacttgacccctgcccatttatgagcgactggaatgagatggaaaacactggcagaagctgcttcttggctcttggaaaggccagtatttctggggcctagtcatatgatcttactctttctagaagacattaataatctgtcaacaaggatggagtatctatcaaatcctaaatgctgcaagaatgctgacgcccagtaagacaaccaaaaggtgttacctggtctgtgttgcctttggttgttgagaacagctggcttttcttaaagatccctcctgcactgtgacttcttcatttacatagagcaccaccccagagttccttgaatcttaaaacataaaaaaataaaaaatcaattatataatttaagttgacaaaactaacatattcattgtagaaaattaagaaaatgaagataaacagaaaattactcatagcttatgacttaaagatttctacatttaatgttttgatgcttattctttcagttttttttctttgtatatatttacatacatggtttatatatcatattgcattctgttttgtggctttatttattatgtagatatatatgatgatcatctcccaggtcattaattactttccttcaaccttatctcccattctcattatatgcatgaattagttcatttaactattctcctttttaagctgtttccaattatcttttgccattacaatcaatatttcctataatattttggaaaatacatttttattcacttccataatcatttccactaaatttgggttttaattgctgaggctaggatttttgccaaatctcaaggtttttgccaaattttcctccagaaatctccaaccaatgtatgttcctaccggccatgtatgtgacaatttgttctcccacattcttgccttggttcctttgactgtctagagttcacttcttaacaacacatgagtgtacttgggataccctactcccaactatcatcaaagttccatgcagacccgaatcagtatatgcagagcttcttatttcttgttttggggtgcagcaaattgatgttgctactattgttagcatcttaaataaaatgaggcaggctagcagcccctcctggaagttctggcaaactcggtgtaaacccaagatgcctagactaagcctgttgtggccaatcaaatcatgtggacctctttaatgactaactaggatttggccatggtgaatggccctcgcgaacatgcagaaataaattggaccgctcataaagtgatccaggcagggtgaccctgggtgggtggccctggctccaaacttcacatggcatcctgtcccggcttttgtccctgtaagtttgtcactcaaccagccttaacctctcatacggagcatctcctggagaccttccacagcttgacacactgggagagtcactcgaagaagtaagagctgacaggtgctgtcccacaaagctctgagtgctaatagcagtcccctcacctgcccatagggtttctctttcttttctcttctttttctttcctcccttttttaactgtgttaatttaatctcgccaatatcaaactcctatgcgagaggtaataaaatccttttaggagtgaagcagagtttatgttgagaggaacaatctgtcagttttgcagggtgctattagatggctgctgtgcagtgtgctgaggcgaggtgaggctggctgcctttgtctgtggccctgctcttctttgtgacaagccttgcccagggcaacgtggtggctggtgattaggagagcttggccactacctcaggagtgctccactgaagaacctcatgaaaaagtggatcccaagggctcttcttgtttgtttaggctctgctgttgttattctctgctgctgtggctatctgagattgcttttccataatccacctgcttgatacctggtttctagcactcctctgttcccctttcctttccaccggcctcccctcaataactgtgagcttcctttgggcttgctaaacactaagcagggtcttgggatgtatatgtatccatcttcctgcccttccgtgctcaccagtaggaagctaacgccggaagacccgagttcaaatctcagttccaccagttagggtctttatgtccttgctcttagatcttctttgcttcagttttgtcatttgcaaaaattggcacagtaatctttcctagcatttatggaagggttaagtgagaatatagtaaatcttctgccacagagggcaatgtcacttcatgaccccaaagggcaccatatcacgttgtcacctagagttgtacattagtcccttctccagctccgtgtctgtacagagtaggcaattggcaaatggaagctgtggttattgtcgatattattttttgttctgcttttttctgaaagctacctcaagtcacttgctgtgctgttacccctaagggtattctagtgaatgccctggttataactggcctgcaagcctgggttcccagtctctctgtaataaagcaagagaacacaggggtcctctcagattgaaccctagaaaataaccatgcaggaaccaagttgtggccacacaaacacactaaaaataaagcaacaacggaaagatgacaagagtggctcagcctccctccacctctgagtggaacctgagataccccctcccttcctgaggcctgcaattcctcacgcataatgacctcagtggtttctctgagttatgctattccaagactctgcaaatatgagtgccttttatcatttctatttttaagagggaaatggagaaagaagaggagtggatgagagggcaggttgaccagtccagtgtgaggcagctcctcagaatgacaacagtagcgacaggaaatcttctaggagatggcgttttgccacaaggtctcaaaatagctaggaagagagtcttctcttacaagggtggcggtgggggtggtggtagggatcctttatgcaaggcacagggttgaatattctatgttcactcatttttattggaagatccatttgacagtgtctgtttttctgattatttgattttgttttgattttgatagttaggatagttgggtaagaagaagcacctgtcaccccttgagattggcctttgagagtccaagttagaattgtttgttcatggggtgccaagtattatcccagggagttgggagaaggtagcttcccatgtagctgagtccaaagctcgcaccactcaccgcacgacagccagtaagtcaagagacaaggtgttggggcaaggaagatgccccattatggaagatgtccccataatatttcagggagccagcaatctgagaagatggtgggctaatgtcctaaagaaccaccttaaagggcataaatctcaagcttctttttatattgggaagggggaaaaaggaggcggctgaggttaggaggtggcaggtgaccacaaatgtttgggcatcagcaggagtctaaaagggttgcataacttctttgcccttggtcaggccacagtgcttctgtaaatcattagaaaaacattattacttgtgtgtatgctccttatctctttgagggctagttttaggaagggactattctcatccttgtcttagagttaaactataaacttaactccccccatagttcatttggcctatgtgcagagataagcaagaacagttaacctaaaagatatcatcgcagatggtgagagttgggggtcaggagcaacatggagttagccatgttaggcctccttttcactgttatacccacatcagaaagagcctcttggtttgtatgttacaaaaccataaattcctctccatccctttgatatctctttcagcctctgccatgtctgtctacagaatttggctgatctcaggtgaaggccatgacccacatgagcaaggtcactgtggaagggcatgtgctaggttttgaaaatgcttcttttttattaatattctcaaaatcaggcaggaagatattcctgagtttttctggtacttccctgctcctctcccaattcctatatagactctccaccccgtggaatctagtgatcctttctgaatagcgctaggtgttcccgttctgtaatccaagtaaaccctgctgcaacaaatttaaaacaaaaccatatgtaaagacaccctacccaggtatctagcacagattatgagtattcaatatacctacattgaatttgaaatgaattatctttggacagagatgtggatagttaggctgcctaagaagcaaatatatcctaccacagtctgggctctgcgccagcagagaggagtccagcatagcccctcctctttgggagaccatgtttttgtgagtaaagccacataaggagcagcttcaattcacagcctggagtttaaatggcctctccatgcaggagatgtgatttgcatttgatcttagcttacctttgggaaacaaatcatttccccaaatagaaggtaccctacttaagatagacccaatcctttcgaatctgttaagccctctgttgagtattgtcattttgccagcatccccaaactttggtcactggagcacttgacagaaggctaatacttaagaaataagttgtaataatgagaattccttctctgtagacagtctttgcattccagtaaattgggtccacattcactggatgagtattttgtgaagtgtcatactcaaatgtaaaaggtttatggatgagaagtttcagattttttttcccccttcttcactctcttctttccaattgttctgctattgagccaatgcagtgtggtggttcattactaggagtgtaatggccttatcaaggaatgtaattgtcctgctgtactggccctgggcagacaccatctggagggtgagcatttggaagtttcccagcttagagagaaaactgataaactagagctgagagatggttacaggcctggaaaggaggccatgcagtgaacagatcaaggaaatgggatgtatagtgtagaaaagagtagagaagtcctggtaattgtgttcaaatagtggaaggactctcatgtgaaaaggggctagactgaatcagtctttgtccagatggcaggactaggacccataaatggacattagagagcagcagggttgagtttagactgggaaagacatgtctaacaattaaagctcatccaacacagagaagctgtctcgtaagccacagacggcacccacccatggttgtccagcagaaactggctgtctgcctagaagagcaaaggggatgctggacctagttgggaaggggattggttataaactttgcttggcctgctggatttgatggctcatccttgtccatcctcctctctctattaatccaaagttcactagaagtccttgctgagcaaggccctgggtcagtgattctcagtagtatctgttgaaaaccttttgaaacatcactacttagaccccaccccagaatagttaaatcaatatatctaggggtgggactgaggcatccacatgctttaaccaccaccactaccccccatgcccggccccggtcattttcatggggagccagggttgggaacaactgcttcagacaaaaagagaatgtgataacaacctcgctcctctaaacatatcgtatgatatttttaaaaataaaacagttttgtctcaaattagtagcatttaagcttagatcctcctagatggttttagtagcttccatgcttacattattttagcacagatcactggctttgaagggtatatgaacatttatgaacacatgtgaaggttatatgaacatttggatggacagtgaacatgctccattttcagacgcgatggatgtgccattgacagtgaacttggtattctcttgtgctcctgtccctcagcttgcaaaaggccagcagcttcctccacgcccagcccaacacccctcctccaatcaccgggctactgttgtatagccaggggcctaaacagctacaaactgggcaacttcccccttttttagcatcttctggatgatgcaagcactcagtttccatatggggctggttgtgagccaagaagagaggaagcacaatctctggaatggaatggaggcatggggattgtttaacagctatcgtgggatcatctaaagctgtgctgcccaatagaaatataatgcgagctacatacttaattcaaaattgtctagtagccacttaaaaaagtaaaagtaaataagtaaaattaattttaataatacattttatttaactcaatatagccaaaatattatttcaacatgtaaacaatttaaaacttactacattaaaattacattaagaattattacatattaatgagaataatattagactaaaatcacatttaaatttattacatattaatgacatttcaggtacaatttgtatactataaaatttacttgttttaggtaaaaaaaaaaaatcaataatttttagtaaattttacagagttgggccgggtgccgtggctcatgcttgtaatcccagcattttgggaggccaagttaggtggatcacttgagtccaggagttcgagaccagcctgggcaacatgccaaaacccagtctctataaaaaataccaaaattagccaggcatggtagtgtacacctgtagtcccagctactcaacgggctgaggtgggaggatagtttgaatctggaaggtcaaggctgcagtgagccgaaattatgccactgcactccagcctgggcaacagagcaagatcctgccaaaaaaagaaaaaaagaaagaaggaaggaagaaaagaaggagaagagaaaagaaaagaaagaaaattacagagttgtgcaactgtcaccacaatctaattttaaaacattttttatcaccccaaaaaaaggccttcggctcatttgcagtcattctcaattcccatcccaagccccaggcaacccttaatctatttcttgtctctacagctgtaaagacaataataaaatacatggtcttttgtgtctagcttctttcatttagcctagtgtttttggccttcatatatattgtatcatgtatcagtccttggttcctttagattgttgaataatattccattgcatggatataccaccattgtttatccattcaccagttactgaacatttgagttatttccactctttggctattacgtactgataaagctgctatggacagtcatgtacaaatctttatgtagacatatgttttcattgcacttgggtagctgtctaagaatggaattgctagatatatgttaaccacatgcttaatattttaggaaacttcaaaactgctttccaaataatgaaatattttatatatctttttaaaaaacccaaggcttcaaaatctggtgtgtatattatacttctaatacattcatattaagactagccacattttaaatgtttaatagccatgtggggctgaggtcactatggcacagagcaagtgaaagtgtttctgcccagatatcttatctagaatcccaagccaagtcaggataatgtgtgaactaatacacacacacacacacacacacacacacacacacgtacatgctcccctgtgacccacacacatcatgaacacaggcacagcagctccaccctcattactcttcatttatgatttattcatttgcctttacagaatgttgcaataattagattgtgctaaataaatatgctttacaataattcatccatgtcttcttgaaacacatttctcatgggattgaaggtgataaattaacagaaatataccccccaaaatgaagatatagaacctcattaagagttgatggcaaatattaagaatgtggagagacaaggaagattagaaagctgaacatattaaaaactgtgtcataattctggagttctctattatttgtcagtgatgcagaattcagcccatacgcctctgctgggcagacgtttggggctgcttctcctacctatttaatcagtcctactcagatcccaagatgcttggtctcttggctctctaaatttctaataaacagacttggatgtaattctgagtccccaaaaccacctacagagtgagggtcctaaggccatcagatggattcccttcaatatacagattcctggaaaggccgttaaagctcagttgggggctctctgtaccatttcaggcagataagcaaaagtccatccagcacttccagaaacactttttgccctcagatctgggtagacttgtctgaacccttcaaggttcttctgtctgaacccttcaaggtatgttaggtactggatgcatattgactagaaagataacttgcccacctgtgcatgtttataggagtgtatatggacagaaaattatagtctaccctcttaaattttcatatttgacttcttaaaataattgatagattatttcacatttctaaacccctatagtccctttcagttcaattcaggagtcatttatgggtgtccaccgtatgccagaactggaataaatggtgcagagaatgaatgaatgctgaatgaacaaatggtagttcatgccttggggagaaagaacatggatagctggaaacacaggcatacggtcataataacgcactaagttttagaaaatattgcacccaaagatttggctacaggaaaggggaataaggccaactctgcttgaggaagttggaaaagtcatcccagaggaggtgacccttaaatggaccttgaagggtgagcagattccaaggtagagcaggggaagaagggcagagagggtagggaggggtgtgtgcaaaggcttggtggccttaagaagaatgtcgtcctcaggtagcagtgaccagtcttgtgggttgggaggtgggccacagagtaaaccaaagggtcagaaagcagggagctgtaaagataatgttgggccaggctaaagagtttggacttcattctataggcaaaacaaaaagccacaaagctccaaggagaggcaatgaagtcactgggccaaggcctaaccctgagataagcaggaatatatcagcatgaaaccagaaagcctaatccaattctaacagtactggccaggtctaaagttttctgtctctgtgagtaatctcaagtgttatagcacatgccataaacaaacaagtatgtttgcaaatgaaggaaagatcagctcttgattgaggacaatcctgtagtatgtagagatgccagaaagaagggaggactttttacagaagatttagttggtgtcagtcttccagaaaccagaagagtttttaaagcaaaaggaatcaaacaaggaatgcagtgtagacatcactggccagacctggaggaggaaagagacagcctttcatctcaatagaggatttaagggctctcagtctagaggactcctttgccagggcttcgaaagagcgcatgagtataagcttagactctctggagtcaacttggagggagaggacgggagactagatacatgcaaatgtccaccctaacccacaccctaaaatctcaatctccattattactattatgtggcacttaggacctatgtataccttttgttttgttcttgcttgttttcacactatattatatattccctgaggactaggagggtatatataccactttatacatcccccaccccactaatatattgctatatcttggaggtacttacagtctatttcttgacctatcaatgggtgtttccaatgaaagagaatgcattcatgtaggacccttggtgtgaagttttgtctcatgcccatttgttagttaaaaggtcaaaataaaggatactgacctacctctgctatttatgcccagtgtggcaaccttcatatctcttgccaaaagacccaggatctgagatcagtgagctctgagccctgagccctgagaatctggctggaattatttcagaaatcgttctctaagagagtatcagcattcttggctaggttggaaatacatttctcatgaccatttggttcctgagaatcaagcactttcaatatgccttagtgtttctaaatgtgctacttgattatctgctccaggctgcttaagaacagaatttagagcaaggtctcaatttcagagtgatgcttagttcccttattcttttattttttccattaaaaattgttgcatttgcttttttcatctatcagtcagtcagtgaacatctgcctgttcagaacctacacagtactagagaacaaaatatatgtggttttattacacatttgtgtgacaaatgtttctatgcatagacagaccactttctttaagaaacattgtagaaaagagtctgataatgaagctaaagtatttgtagagatatttttgatttcacaagttagtattattaataaaaggagaaaaatcaaaatttggaaatataatttactacaaattgtctggaggagaaatatttacagcttatgacacagactgaatagtgtaagcttataaacaccaaatggaggctacctcatggcccttgagggctagtaataagccttgagaaacctagaaaatgtcatcagtatatacctgtgcaggtagaatattgatcagaaaaccctaagctaaatgtcacttccacatttaaatgaaacctggatggttctcacaggccccactaaaatcaatagcaaaaccctaaggcttcttgataatagcttctgtatttaaatgagagtgaattcatgaaatcacagtggccacctttctatttgccctgccttacctgccaccattcaagtccttatatagagactacaaccttgagaattgattcttgctacatttcttgtatccctcgtcattgaaagttgtcttgacagtaacacaaatcctcaagacagtcttgtttgcaatagtaaggactgtgatgacaataataacaggagtgaacagttcttgaacccttgctgaatgccacacagtgtgctaagcattttacatgggtttcctccgtgagacttctccatagttctacaagagagtcctgtcactgtccctatttcatagacactttagaaacgctacatgccttgtcctacagtaagatcacacagcaagtaatggcagagccaggacttggcataggtggtcagagctctgaacagtggggaaataaccccctaggctgcggcatctcccagataggctctgcagatactagttgggctatcacaggtacaaattcctgatgccaggtttggcttggggtgcattttgaccatctcctcactgagggggcatacagatgctcaggatttcaaatccagcctcttgaatgttcggatccttgagcctggcattttagattgtttctttctacacaagattatacttttaacagtctgaaagacattttttctaccacaaccaaaatttttgtctaagtcatgtttataaatatttaacagttatctttttccttttctttagtcctaaacaactgaccatttttttcactctgttttctcttctgattttcaaagttcaagcatttctgctttccaaagaaattgggagtctgcccctatttatttaccatcactacctgcagccattaggatgtaagatgcaagataccagctgtatcttcaggctcgttcaattgaggtcatttcactatctgcttcttcagttgggcttttgttacagaatttatgaattgaagtcaatataaatcatattcattaaatccaaaccaagggaaggggaaggagagaaaggtggagggcaggggtggagagaacagacatcaatttccacttacagaaatggacagagcaaatactcacagattgactgttcccaattaaacagtcagaactagatttaaatttaatccccatatttccatgactggggagattacccagtaaatttcagcagcccagcctgaggtcctcaaaaaaaactcaaatgcccacagcagcctagcaggtaaagtaaatgagtgaagtgggccaatggtaagatgataaatggccactgaccctcagcctcagtgagggggacattaggaaattgtggggactatggggaattggagagacatggccatctgagggggtagtgttacaggaaaggggtccccatgcagaacccaagagagggttctcagatctcatacaagaagaattcagggtgagtccatagagtaaagtgaaagcaagtttattaagaaagtagaagaataaaagaatggttactccatagacagagcagccctgagggctgctgttgcccttttttaaggttatttcttgatgatatgctaaacaaggggtagattattcatgcttcccctttttagacaatatagggtaacttcctgatgttgccctggcatttgtaaactgtcatggtgctggtgggagtatagcagtgaggatggccagaggccactctcgtcaccatcttggttttggtggggttgggctggcttctttactgaaatgaaacctgttttatcagcaaggtctttatgacctgtatcttgtactgacctcctatctcatcctgtggcatagaatgcctgaactgtctgggaatgcagcccagtaggtctcagcctcattttacccagaccctattcaagatggagttgctctggttcaaacacctctgacagtagcaggtattcaaatccagccatttattgccaccaaaaaagaaacaataggcccaacattgccagatcttccttcccttttccaaatccagaacagctccagatattcaagtggttactgtttcctgacttttaagcattgaagaccaatccaaatctaaaagtcagtgcagaccaagcctttggccaaatgaaaacccatccaagaacaatcaatgtgctctgaaaggctgacaatttgcaagctcttttctaaatcttcttctcccagccttgctattgttttgcaatttagatctcacttaaaatttagggcttttttctctctctagctctaatagctaaggaagtcctaaagaaagctcaatttacaacacaaagttagtgactctttacaaaggttttccctttttccccccacttaatgatatctatgaatataattatgcttaaaatttccagccaaagatccataaagcaaggtatacctttacagtgactatttttgtcacatattaatgaaagtaatactatggaaagctattacagacactcaagttcataaatataaaaaggcaaatcagtaaacttcatatataagatttgatagcataaaattgtccaaattgtttacattaaaaacaaaactaaatggcaaaggacacatggaataatttcttttagcaaatataatagataaagggttaattaagagcctagttttaagaagttcttacaaatcaacaaggaaaacactaagcctccaatagataactgaacaaaaaaaacagacaattcacaaaagatgagaagcaactaattaaagaacatatggggaaatgactcaacctcactagtaattaaagacatgcaaattgaaacaacaaatataattcccagttcagacaggggtgcaatgaaacaggtactgccgtgcattactgatagacaaaatataaagcctcatcggtaagcaattagctaatataaatcaagagttcagttctattaggcaatattgagctttttctatgcgctaggcattgagtgtatgcaaatgacaaaaacccacccctgctgtcaaggagtgagcatgtttcatgagagagacagacacaggtaactccattattaggaggtaaatgtcagaagcattcacacatgtggcaaatgcaggagtaaagccaaagagtttggaaggtatcttagtcgatttgtgctgctacaacaaaatacctgagactgaatggtttataaacaattgaaattttatttctcgcagttctggaagctgcaaagttcaacatcaaggcactgagaccgttagtgtctggtgagggctgctctctgcttcaagatggtgccttgctgttgtgtcttcagatgtcagaaggggctaagggaaaaaggaggctaagctagttccctccagcctttttacaaggcactaattcattcatgagggtggagccctcatgactaaatcgcttcccaaaatggcctctcttaataccaccacaatggaaataaagtttcaacatgagttttggaagagacacatttacaccatagcaagagttttatttgaaatgatcctgagctgaatctggaaggatgattagaatttcgctgaataaagaagggaaataacaggaagagaagatgaggaggctttctcagcatatggcacagcatggatgaaggcatggtgtctacaagaactgtgggggcattgagaacagcttcagaagcaagtgtgaggtggacaggcaggatgggaggctggagagggagcccaggcagcccatgctctggtagtgtgaactttttatcccagaggcagattgagatacggaagcagggaatggatacaatccgatgtttactttttaaaattctgcacaaaagtcactgtggtttgtttttctaattcaagaagtgacagataaaagcaaacaacccaactaaaaaatgggcaagggacttgagtagacatttctccagggaagatatgcaaatgaccaataagcacataaaaatatgctcaacatcattagtcattagggaaatgcatatcaaatcaaccatgggataccacttcgcatccattagtttgtctattatttttttaaagtaatacaacaaatattggtgaggatgtatggagagaaattagaatctttgtgtattgctcgtgggaatgtaaagtggtgtagttgccatggaaaacagtctggtggctcctcacagggttagacatagaagtatcacatgacccagcaattccattcctgcatatacacccccaaaaattcaaaacagagactcaaacatacttgtacaccaacattcatggcaatatcatttacattagtcaaaagatagaaataacccaaatgtccatcagcagatgaatggataaacgaaatgtggtatacacataccatgaccttaaaaaggaaggaaattcagatacatgctgtgaaatagatgaacttgaaaacattgtgttaaatgaaataaaccagacctgaaagggcaaacatcatttgactccaattttacaaggtatctagaataggccaattcacagagacagaaagtagaatagaggttaccaggtgctgaggggagggattaatggaaagttattgttaagtgagtacagaggttttgtttgggatggtgaaaatatctaaaattgggttgtgatgatagttgcacaacattgggaatgtacataatgccactgaatggtatactgaaaaatggttaaaatggtacattttgtgctgtgtatatcttatcactgtaaacagtatttttttttaagtagcaggtgttttggaaaattcaagaaagtgtaaagaaaaatattctaacctccagagttacccattttacattttggtgaattttctcaagttgttctgtgtgtagagtcatatatttattagattttgctagactgaggtcacactatccatgctgttttataactgcctctctcttctaatgagagcttatgaacttcctagttgtttatacagcatggtggttaaggatgtaagtcctggagaaaaaccaccagggtttttttgtcttagttctattgcttactcagttatcagctttgtggctatgggaggtcacctaaccctctaaatttgtttcttcatctgtgtgaaagagacagtaataataataccaagcacatgcatagttcaggattaaattatatcctaaatatatatataagcacagtgtctggtactcagtaaaagaaagctattgttattaatatttaaaaatcctcacctattcttccagagaataattttaatgactccatgaagtactttattatgtggatacaccatactttacataactaatcttatgtattgaacatttaccatttctaaatatttactcccgtaaataatgctgggaaactttgcaaacatgtctttagaaataactccatttctttaaagcaattcctagaaaggaaattattgggtaaaagaatatgcacagtttaaggtttttaaactgtacatattttggtggactatcttccagaaagagtatgatattcacagaagcaggagaacaactttatcaatagcaagaaactggaaacaacctaattgtttaaaacaacagattaaatgtgatgtccagttattggactattacacaaatatttataaatatgtttgcaagtcctacataaaaacatagaggatgcttacgacaatgttaagtgaaagaataagagaaaaaaatattttaaatttttaaaatcctatgcaggtggtgaaataaaaaaccaaaatggaatggttaattggtaggactacagataaattttttcttaccatttcttttctaaattatatttaatgcacataaacaagattgataacaaaggaaaaataattttcctgggaaagtattatttgtccctatatttgaaagctttcattgagatgtagtctgacattgcaagtagaactttaaataagcacccatgataacaaagcccaaatttcaattttctggttgaaaattttcagatacaaagtcaccttcttcagccttatctatgtattcaaaaactgtagagattggagatttctgccatatagtgttggaatcagcaacaagatcagacagccattatttctcaaaggaaatgaatctaaaaagactctagaaataaaagcaatataccatctctcaaacagagtccagctgctttcataaaggccaaggtccagggaaaggctctagctgtctagtcatcttcatggagctcctgggctctgggcccctcagtctacaccatcttgagctgataggcaagttaattgatatctccgagtctcagttttctcaactaaaaagtaggtttaataatcatataactaccttacagggttgttgcaaattaaaatgcagtaaaccttgcaaaatgttaacatattgctcgggactaataggcactggataagcattagccattattattattatcgtcatacactagtttacttgctgttgttaaagataagaacagcaaggcctagggagatgtgacttgtcctagtttagcgggaagagccatagatttgtaaagggacctgaattgtaatagtaattgaagcacttttttatccaggggcttagggcaagatacttaatccttaaagtagtgctaatagaaatacaatatgagccaaaaatgtccttttggattttctagaaaccacatcataagaagtaaaaagaacttcattttaataaacatttaacccaagagatccaatattttcattttgacttgtactcaatataaaaattattaataaaacattgtatgtcttctgtactaaatctttgaaatccagtatgcattttatactgatagccatttcagtttagagactaaattttcatctgaaatacttgagatgtattttataaaatttattcttggaaaatcatattcacatacccaagttgttccaaacatatttttccaataactgaattaagtttcagtacttaaacttaaattaattaaaattaaataaaataaattcagttcttcagtcacgtcagccacatttcaaatactcaaaaaccacatgtggctattggctgccattattagacacacaactacaactggggatagcatctatttcactgggttgttctaagattgcatgagagagttttacaaatcataaaacgctgtccaaataaattacttctcctccaaggtcacccaactaatgagaggtggctcaggaacaagaatcaggccaatgtgatttccacatatggacatttgaaatttgaacactactcatcttgaacctggctttcaatctttttaaaactgtgattcacagtaagaaatatatttcacatcacaatgaaagacacatacacctgtgcatgtgtgtgtccgtgtgtgtgtgcgtgtgtgtgtgtgtgtgtgtgtgtacctgtagatcagcagccactgttatttcccaaaagagagttacaatgaggatattttataaattaattctgcttcttcctcctgctggtcttctcctcctcctccttctcctcctctctgtttagtgctggtcatgacccactaaattgatttcatggcccattaatgggttacaaaccacaagttgagaaacactgatcttaagagtccaaacttcaaggcattttaaaaattgatttgttttatgttgcaaagagtaaccctctgtagccactcgtcataatgttcaaaaaggaaaaacatcccccccaaggtaaataagaaatatgacactgctttagataagatataagaaaataagtgagttgcccacttttttgttaaatattattaatttattcattcagcaaatgtttattgaagaaacactgtacttggcattgcaccaggtactagtgagccccggcccaagacaggcgggatccctgtgcttatagaagttcagctccaaaacaacagaagccttcgctgcgatgacttagccagataaggatcttgggtgttttgctgtgtgtttcccacaagaagagcggagacaggcagttcagcactggcatagatatccaatgacaccattagtgacttaactcttttttttttttttgagaccgagtcttgctctgtcgcccatgctggagtgcagtggcatgatcttggctcactgcaacttccaccttccgggttcaagcgattctcctgcctcaacctccggagtagctgggattacaggtgcacgccaccacgcccggctaagtttttgtatttttagtagagacagggtttcaccgtgttagccaggacggtcccagtctcctgacctcgtgatccgtctgccttggcctcccaaagtgctgggattacaggcgtgagccaccgcgctcggctgtgacttaactcttattactttactagtccacatcccatgttgtcaatccctggttacaagacagctgccacacctccaggcattatgttcatattctaggcaagaaaaagaagaaagaagcagaaaggggaaactttccccacagttccccgcaccagagggctgccagataaaacacaggatgtccagttaaatgtgagtttcagatgaacaacaaaattgttttttagcataagcatgtctcatgcgatatttaagatatattttcactaataaaattgttcgttattaatgtgaaatgcacattgaactgggtgttctatatgtttatttgctgaacctggcaaccatacgagcataattctgctcacatttcaccaccagaactgtgtcacatggctgttcctatctgcaaggaagcctggttaaatcaagtcttttttttaaacttccagtctcaataaaagaaggaggcaagagagaaggaagttggttggggacctgagtgagccagcctatgaaatccaccgcagttcagttcccctctggcctttcttatagatcatattatggaatttgtttttgtttttgtttgagacagagtctcactctgttgcccaggctagagtgcagtggcacgatctctgctcactgcaacctccgcctccctggttcaagcgattctcctgcctcagcctcctgagtacctaggactacaggcgcacgccaccatgcccggctaatcttttgtattttagtagagatggggtttcaccatgttgcccaggctgatctcgaactcctgagctgaggcaatctgcccacctcggcctcccaaaatgctgggattacaggcatgagccacctcgcctggccccgtattatggaatttctgttttaatctgtattcagtgagaaggaattgaagagtttaaaagaagggaaggataacctaaattaaatgtaagaagatggttctgacttctgtgtgtagaatgtatgaggaggaagtttagacctgaagtgaaaagatctgttagaagcctagaacattctagaacctttgagaactcagcctagccatcttgccatgcagatacctcagcttcctgcatgtgcattgactcttccgaaaaatgaagaggaatgggtgagaggcccatgggtgctccatgcagctctcccagagtggcagcaggtgacaaacagtgatgcattctcagcttccctttgcttctcagctgcatggcttggttattaacatccacccacgttccatgctccttcttcagcagcgggtatctgagaaccacagtagatggaacatcagaacttgttataataaggttgagattttatgagactcctgcaaggaaatgggcaaaaaattgctttttaaaatatttaattaaaaaaatcaatggaatgcccagagaaagcaataaaagccgctacctcttagcaaaaattttaaaagtaacatagaagatgtttatcccttgacatctgggacttaaagcaaaaattgaacaatccgattccagagctaaaaaacccacgtgggaaagggaaaacctgactttgtgcttctctctctctctagtgggttttgttccactgaaggcaccctggtcgcccagctccctcccttccgtcctcctcctccagcaggtgcttttatctctccttcctcctgtttctcattgaattaaatcaattctttagttttcattttgttcccctttctccttctagtcagatcaagtgcttttctattttccttgaggattaccaaaatgagctcttagggaaaaaggatttctcagcactttgtcttctgtttctttctatttatttgctttgccttttattatctttttttgctgacaccccagggcacgcatgcagtatgtagagattattggctctgccccttttttctaaatgaaatccattgatgtaaaagaaaaaaaccacctttgtgtctcacctaaaaatgaggtgagatctaacagggtcagattttaacagggtcagagatctaaaagggaatatataaaaacgtactcctccacacatagacatacatatacatccgtacatatgtgtatgtttatgtgtatccatctattgatgtacacgtatatacgcacacacacatacgcgtattttactacacacacacatgagcataaatatatattatttctagggaacttctgcctcagttaagtaggacccgaaaggttgttttgccttttcagtttgcagaggctcctaattgtgcaaattgtactactacttctaggctacaactaactcattatcttaagattaataatactatcaagaaaaatcaactccctctactccccttctctctcttaatgaacacacttggtttttctaatgattcagtctcaaaaacgaataccatttctcttcaaagtgcttccgaatgaaggtgcagaaaagcaatacatgtaagtcctggtggtggagagtaacagagctaattccaaatatttgacatcgagacagagggagacagtaaaagtgcacagggactgagtgcccacatggctcagctctgctatggaagccaggcatagcccttcacccactggactgtttcctcagctgcaaggtgaacaggttggaccaaatgatttccaagagcctctagagctttgaagttctgtctttccattatctcaatattaggcaaagcatgccaatgagcacggtcccacctcctctttattctaaatgtcaaaattctgctctaacaactaaaacatgagttgaggctacacaggatagtagaattcaagtttgaaaaataaacaataaggagcctctttcagtggccccagtttgctttgaacaattcataagaccacatgaacaaaggaaaccctcaaatactgctcagccatggtgaggccatctaagccctgtgagtgatttcaaaaggaggacccactgtctgggtcccacctgcccatgcgttagtctgtgacctctggggacagtcagaaagaagagcttgagaccagctgctgggcctgatccacagagtggtgagagtgctgaaaagtgaaaggaacatctgcaggcatctggggaccaaaccacagggcatctgactgaaacaccttcgtagatttctatcatggacaggcatatacccagtgagtgttctactggacagaagtctggaaaccttgcttctaattgcagatccaccaccaatatgctgtgtgaccttgggcaagtcctgaacttctttgcttcttggttttctccccagtacaacaagcgattaagctacgtgacaatcatgtttatgtctagttacgacattctgaaagccagatatggaatgtagcatttttaagtctcctcaggtagcgagaccagtgcagtaactcagaggaggtttccaggagcgtgattctgccagaaggagctgaggtcttatgaaaggacagtttgaaagtcagacaagcagaaaagacttgagagatgatacagatatagatatagattagacatacacatagatatttatatagatagatatggataaggatatgttgtttctcctttttttccatgatttcttcctttcctattttctgcaaacggtctttgcagcagaaatagattagaggagggtatccaaagtgtgttccatagaacattatacacagtaacaaaagggttctgtgcacaaaggagtttgggaaatgtttcattttatattccactcttgaagagccacaactcttattggcatatcaaggctctgagaagtcttcagtgaaagagcctgtttacttcttgttgtacccaggagtccccagactcattcgcccacagagccttctcataatacctgttgacatccatggggctggtgttctgcggaaggtactctggagttggcacagcattattccccaacactgatatctcggggcatgcatctgggtgaggcctgcatgcattacactgcactccttctgtccagattccaacccattaaacctctgcttttccttagttcccacctaacatgagtggcattgtgatcaactgaaagagtaatagcagataataatgatttaatagtttattgtactatggacaattagccaatgatgcctggatcctgtttgattgattgagatggaaatccatccatccatgcatgtgtgtatttatgttctcactcagagaatatgattaagaggcctctggttcagaaaagtggattgaacatttgtctcctcttttaagatcccactgaagttatattaaatagagaactatcaacggaggaacaaattctgaatagcaaacagagcaggaggggaggcatgagcaatttctagagcacatagaggagacagaagctgtccatggaaaaacaaagtggccagagcccagaatgtgccaaaaaggtttagaatagaggaggtgtcctatctgctgagagtgcaggtaaaagatcacctgaaagaaaggatgaaggtaaagaagaagaatggaaatttctctatggttaacccagatggccttcattcctttttcaatatcattttcccaaagcagagggtagcaggatgcttaaccatagggctaggaaaaagcctctaaaacttcaagtggagtgatagacttatggctgctagtgggagtgttcatactcagggtgacgtgccctttgggctggcactgggaagcagtcacctgcaaaatggcttgctcctgaaactgtccatcaggcaaattatgcataaaggacaaacaccatctgtacacatatagctcctgttagcctccctagtctctcctgtttaaatgtgagggactgatcaatgatcactcaacatgtgaataatccagcagcatgaaaaagaaagatcatgcatagcaagacagccttttcttgccatatgtttcctcccctcacccttccataatctgctgccacctctccccaggagctccaagcctctgttcatttctgcatagtataaaaacttctgtcctctggtccttcaagtctcatattttgtgtggctcccatgcatttgcacataaataaatttatatgctttttcttctgttaaaagaagaagaaaagagaaaaagaaagatcaatatatataaaaaaagctgaccccagagaaaacaaagataaatcagataactaacagaagctaacttgaaagataaatctcttaagaaagattcaagattaagcatggggtaattaaattatcagagaaataataaaacaagatttgctagagatgaaagaggcatgtgttttctgattgacagaggccagcaaatgccacggataaatttttgtacagatctgtagctatatgcattgcaaaatgccacggatgaatttttatctagatccctacctagatacaatgtattgaaattttagaactttaaagttaaagaaagatcccaaaagcttccaaataggaaaaacagatcaattacaaagaaattacaaataaaaccagcgttagacttcttcttagtaacactgacactagaaaacgctgaaactaggtcttcaaatttttgaggcaaagtttctaatctgcaaaccataaccagaaaagctaccaaccaaatgtaaagatgaaataaacatttcaaatattcaatgattcactaagaaatttccccctgaagaagtttcctgaggatggtgggactaacataaaagtcccagtgaaaagaaatttcagaataatagctgtaccgtaggcccagaaagcaactgatacaaattaaaagaggaaatcagtgtcttcaagacgaagggagtaattttttcaaggagtatatggatgtgttagtgatatggtaaagaagacagatataaaataaatagaaaaaaatcagctagaaattcctggaaagacaaactgaaaaaaaacaaaacaaaacaaaaactgattctgtggggaccgagggaaaactttccctttgccctccctctgaaggttcatggaaaaattaacccacaaagggcagattaattggagaaaaagcacaccaatttattaatgtgcacacaaaggaaagtcacagagtgattaacccacccctcagtgggatgcagaagcttatttgccatcttgaagttacaaaaagaatggggacttggagtatggccaaaacaggttatagttgcaagacaggttatgggaggaagggaagaggaggcttggctagcaatggtggtcttgttatgtagatgaaatctcacggtagcagctttcaaatagaataaataataaatgtatttttcagacttttaaaggtatcaacctctccgttaatttttcctagctctggacaagggaagagctggttgcatcagtgcagattttctacagatgcaaatctgccccacaaaagacagctttgcaggaatacttttgttttctgactctccaagcagccatttgaaaatatgtcaaatagatatagtttggggtaaaatatttttatttccttcagtccccactttgaagccttaacaagtttcacatgtttggccatgtgtggtggctcacacctgtaatcccagcactttgggaagctaaggcaggtggatcacttgaggtcaggagttcaagaccagcctgttcaacatggtgaaaccccatctctagtaaaaatacaaaaattagctgggtgtggtagtgagcctgtaatcccacctactcaggaggctgaggcaggagaattgcttgaaccttcatggcagaggttacagtgaactgagatggtgccactgcactccagagcaagactctgtctcgaacaaaaaatgtttcacatattaaaagccaagttgatagctttggagaggtttgggttagagattattagagatagacaaaagagtggaaaacaaattgggatatgcagaaaagaatacatttaaatataccatcccatctctctttaaatcagtcttttagtcctgagaatagatcagtttggttaaacagttgtgtcccattccaggaggtggcattgcaggtaggctaggctctatatatgatgcaggcaaacagatcataaataaaaggtatttctatggaaacagggaaaaaaggctaatgtctggaatagtctataaactactttttttttagagtctctgaagcatcttcagatttcagtgacaatctgacacatatttctggattgtagtttgaattgggtgtttaaacgaactttgtgagttcatgtattactggctgtttatatataatttgctgtggtaatttttcttgaaggttatttaagtggcctatctttagtttgcagggttataagaaaagcacagttttaatttctaataatttcaagttagaaaaatggaagaaaatttgaaaatgttatttttggagacttgtagccaagaaagaagtcaggattcagtctacattgtgagaaaataataaaaactcaaaaataatggacaaggctggaatctcataacagagttatgaggagaaaaacctatagggttttttttttttaaaaaaaaaaaacataattcttctctttagtcctttatttctaccaaagacaaataatggtatgacaaacttatttgcaaaataagtattagtttgataatatttggcctgattattcatataaagcatagcaagaacggtgattggtcatagaggctcttataagttagctttgttggaacttttttacaaggaatctaagattagactttttaaaacctcgaggctagaaagccaagccaaggatgtgccacttatctatatctgtaatacctgtacaaattgggtgaatttttcccttctcaaggtcttaaaatatcttgaggtttctgggcctgtcagaaagtgacatcttttacttaccacaggtcaggaaccctataaagaaactgtgtagaaaagatatcaggtcagactttttaaagggcttcttatcagctcaataaagccaatctaaattcctcaaagcagtctgatcatatttgaaaatataccatttcagtcaaggccttggtaaaataaccactatatccaataaccactatatccactattaactactatatccactattttgtcctacaaaagaaaacagattctaactgaacttgcgtaaataactatattgccataaattaagaatactcacaacttttcaaaattctggagaaatcaggtaaagaaaaaactaaatgttttaattttgctcacaaaactatactttacccagttgttgttgtaagctctaagtagctcaaaagaaaaagttttcttaactttagacaataaagcataaaaagaatcaacaatgtttcaaacaaaaagaagtcattagaaattattttagtcctttattagttcagtcccatgtaattaattcttgtcccacttgatgttgtgttggcaattttcatgaacacttcagattattaaaattagagtcttgaactttttttacctagtcgaatgatatgatctaccctgtgctcaagagaacctgtcagagtcctttcaatgaattaccttaaagaggaagcaaattttggacagtagctgattacaaacctttttttgagaataatcaaagtaaaacaataattgtctgtagattaaagaaagacagaaatagctatacttaaagacacaactggcaatgaaatttggttatttttgtggcacacgacaatttaacataataatcttaattattgctgataacatataccaagacttatttcaaatatgagacaaattaaaatgtgccacaattttgacaagtaacaatgcaagagagagaattcatttgatcctgatgctggaaatatatcctgcttggagtagaatgcattcttggatctatagagaagattataaatataacccttattcactgcagtgagaaatatatagccatcagtataaaagatctgtttattgattttccacacttagcatcaacctataaacaaaacacaaaatacttaatcattcttacacaatcttgacaaggtaaaggaaaagtacagctgatttgggaggggggtgtggaagagaaaaagtacaggaaagggcaggaagactaaatagcctcatctttatagtgagaagagtcaagtgatactgcctggagctgttggaagaagtcataaatatatcacataaagttaaaaacgtaaggtgtagaagataatttttaaaatcaagaacattttaaaaatcaagaattatgaaagagatattgttatttttcttattgtcctatccatgtctaaagttgtcacacctgcaaggaaaactatgattataatatttagaattatgaaggcagcaacctaaagaagttagaaatccttaaaaaaaaattttccagtgtgtggaatgtggtcaggtggagcagaggttagaggctgttttaaaaaaaattataagcaattctgtactatttgattccttgtcatgtgtattagttcatgcttgtgtcactgtaaaggaacacctgagtctgggtaacttataaagaaaagaggtgtaattggctcatggttctgcaggctgtactggaagcaaggcaatggcatctgtttcctgagtgagggcctcaggaaacttacaatcatgacagaaggcaacaaggagccagcatgtcacatagtgacagcaagagcaagtgaaagagaatgaggaggtcccagactcttttaaacaaccagatctcacataactaactgagcaagaactcacttatcaccaagggggttgtattaaaccattcatgagggatttgcccccatgatccaatcacctcccaccagactccacctccaacattgggaatcacatttcaacgtgagatttggagggacaaacacatccaaaccatattatttcacccctgccccccccaaatatcatgtccttacatttcaaaatatgattatgccttcacaatagttcctcaaaagtattaactcattccaatattaacacaaatgttccatgtccacagtccaaagcctcatgtgggactcacctatgtgcctataaaatcagaacaagtaatttacttctaagatacgatggtggtacaggcattgggtaaacattcttgttccaaagtggagaaactgaccaaaacaaaggggtaataggcatcacacaagtgtggaacacagcagggcagtcattaaatcttaaagcttcaaaataatcttctttgacaccatgtcccacatccagggcacgctgctgcaacgggtaggctcccagggccttaggcagctccacccctatgactttgcagtgtgcgtcctccatggctgctcccacagattggagttgagtgtctgcagcttttccatgctgaggcttcaagctgccagtgtctagctgccagtgtctctaccattcttggatatagaaggcagcagcccccttcccacagctccactaggaagtgccccagtggggactctgtgtagaggctccaaccccgcattttcccttgatatggacctagtagagtttctttgccagggctctgccccagtggtagacttctgcccatgcctcctatggcatttagatgggagctgccaagccttcttcactcttgcattctgtgtgtctgtaggctgaataccacatggaagcatggcttatgttatccaaagtggtgtctggagccgtacctgggcccttttgagccatggctagagctggtacagccagaatgtaaggagcagtgtcatgaggctgagcagggcaacagcaccctgggcctggcccctgaaaccattcttgcctcttagcctcttaggcctctgagcctgtgatcagaggggctgtcccaaatagttttgaaatgcccttgcgatcttttttttattgtcttggatattagcccttggctcccttttagtcatgctattcgcttagcgagttgctccacaggccacttgaattcctcccctgaaaaagttcttttcctttctactacctgagtagtctgcaaattttccaaacccttacgctctgctttccttttaaatataagtttcaagtttgtcatttctttgctcccatatctgatcatagactgttagaagcagctagaccactcatgaacactctgctactgagaaatttcttctgccacataccctaagttatcactcttaagttcaaccttccacagatccctaaggcatgaacatgaatgcagcccaattatttgctgaggtgtaacacaggttacctttattccagttttcaataacttttttatttccatttgatacttccttagctttgtcttcactgtccatatttctatcagcattttggtcaaaactatttaattagtctctaagaagttccaaactttccctcgtcttcctgtcttgtgagcttctcccgcccaaattcctccaacccctgcccgttactcagttccaaagttacttctatattttcaggtatttttatagcaaaacaccactcattggtgccaattttctgtattagtccatgcttgtgtcactgtaaaggaatacctaaggctgggtaatttataaagaaaagagatttaattggctcatggttctgcaggctgtactggaagcatggcaatgacatctgtttctagtgagggcctcaggaagcttgcaatcatggcagaaggcaacaaggaaccagcatgccacatggtgagagtgagagcgagagagaaaggaggggaggtcctagactcttttaaataaccagatctcacataactgagtaagaactcacatataccaaggggatggagctaaaccattcatgagggatctgcccccatgatccagtcacctcccaccaggcctcacctccaacactgggaatcatatttgaacatgagatttggaggaacaaacacaaccaaactacatcaccatgttaccatcatatcaatttgatttttaggatcattgagtacctaccatgtggcaagcattgtgttgcataccagacatttagaggtggtagcagccttatagcagaagcatctaagaaacaaatgatgctagtacaggagcccttcctagggatgtatgtgtgtaaatcgggagagaggaaggcagggcagggaaccacagcttacttccttacatcttagcgggaaagttcatggagtatttggccaatcgattaaaactgttggtatataaccctcagagaggtgaattatgagaagaagagtttaggacttgggggcttggagacttgactcaatttctttagattaataatattctaggcaggcagatagaattactgacagtttggggctgtaagaatccttagagagactgtatccaacacttcattttaccaaggaaggttggtagtagcagagctactccagtttagtccttctgattccaggtttagtcctagatcaaaggaattccagactaagacacctgtcaacacagggaactgatttttattacatacctaccttgagcaggcacagtactgcctacttgattcatgttatttaatttaatcttcacaacagccatatgaggtaggctctgcccatattaaatttgagcaaattaatatttaaagtgtttaaataatttgtctaaggtcaataactgaacagatacaaaagagtttgacctctaagttcatgacccttgggttttggcccataatgtgagccctgctggttgagatgagagcagcacattcctacactggtgaccagaggtaaaaataaaaatcatttcatatttaatcattaaacatatcaacaagatgcataataaaagaaacatggttgtggcgctgtatgagcagagctctttgatctgcctctccacacccccatggccacactgggtgaaggtctgtgtgctgctagaccatccttcttagttagaaaggaccccaggagactttgcctagccccaagctatcctgagcaaaataaatagaaaccaaaaagagagagaggagagataaattcttactgactttaaaagatttatactgacaatatcccaaggagcttatgaaatgtattttttcccttatttttggtagaggaaagctgctgatgaagagatagctctcaactatagagttccattgagagtgaaaataagctcagtcgcttattgatagtccggttgcagaaaataagattcatataaacatcatctcacatattagaactggaaaaatcttccagtcagctttgaaagggttccattattgaggtgccaaatttcggggacagaatttacatgcatggccacacccaagggtggagaggagcagtgacacagaaagagcccctagtccaatacctcaacaccttcagctggatttttgagcttctcatgcatgtgcacatgtgcatagcagtaatcttcctgagaagaatggagatactttctttattttgcccccattcttcccttcagtagctcagaaaactcctggtttctactcaacattctgccaacctgagaacatcagagaatggtctcagaccaggacacagttgctgctgctcccttatgtgtaaattattattggacatgggactgtcttcatcctaaccccaggccatacccccaaagagtctggagcaagactctgtccccagagatacttccagggtcctcacgtgctctgcacagatacacactaccctagtactggaaaccccagtcatccaccctcaacacattgcctttgcttacaacagtaatatagcaaacacttcgaatttgcatttagtcacattcttgcccttgtgtggacttgtggtgcaagatgaggttgggtcaatattaattccctcttgcccccaccataacagatcagttctcctgctgcaccactctgatggtgccactcacctgctcaaaatatctggctctctattatccacaaaatgaagctggaaatcttcagccaagaagcaatgctctctgtggtctggttacacctcctatctccctggccctccttatttctcagtcttctctccagtgtcctactctgcagccaaacatcatctacctttgtcctgactcctcttcccttcaacttttgcacagtccattctgccagtatctttgtttttctctccctgtaagacctggctcaagggtcttcctctttacggatcttcccacctggacctcctgtctcctccttcctgaaggctcccaacatgttttgcctggatgtgtgtctgactttatgacctctatttgtgctgatagttcttgcagacatctgtgcacccctgccagacctggagttccttgaaggccacaactgtgtctgtcacatctatgtcctcagggcagagccagtgcttggatgtttgctcaaaataggcatccattaaatggaatctgagggcagaaaggagtaaggaagggaccgaataaatggatttggtctggtgtccatgtgcctctcattccccttcctgcccctctgacttccaaagctatacatcctggccacaagttaccttggccatgttttaggctgaagtacacagtgggccagtgaaaaagaaacaaggagaagagtactgcttagaagtccagaaatctggagtatggtcttaactttcaaactaagactttggacaagtcatttccctatctggatctccagtctgcttccctaggaaagcaagaggactgaattagatgatcttcccaattctttgtctttggttctaatcccttttcttttcctctgtgcccatgataagaacatttcctctgctgcaaaatactgtcataatgtagattatttatgacagttgtagatcacttttcttatatgccatgctgaagcttcccaacaagtacagagggttcacgttctcgatccagctcagacacggtcttatgcttcatcctgattttaaccagaagtcgcttttacttactttaagaaagttggaaacctccaattcctggaacaacaccttccttttgagtaatgctttgccttggtaggaatccccctcttttatctgcaccattgtttattgcaggctgctagtttatttgcctatttgggaaactgggttatctgcagaaggagaccttggaagtgccaggagtagtttaagaagactgagtactcattagctgcttcccactgtggaagtcagggatcttgttgaaacagatttctactgcaaaaggagcagcatctaatggcccaaaacttcaaagcagaagtgagcaagtaaaattaatgtatcagaaggaatgcctggaacaatataatggtggtgtgcttttacactgacagtaatccccatgaatgtaggtttctcgcaggtcatttggcctgtgctactggaatcaagattggcttgctccagagggaaactctgccatgggcacaacaacaggggagatttgtagggctttttctgtggagaccagttgcaagttcacatgactcataggctcaagagctgaaatgaacattaagagattattgagttcagccaaccctctcaccccattttacaagggaggaaactgaaacctaagaaagttaatgcttttccaaagatcattcaactagtaagggaaggaacaagagtcttttgaaatagatgtttttattcctgttttgcagatgaaaaatcgaaggctctaggacacagaagtaggaagtaggggagctaaggttcgaaccttggtctgcctgattataaggcctatgtctccagccactgtccacctgcatcaggctatactatttacaaagaaaatctaagaatggaggaagaaggctgggtgcatgcagagaaggagataatggcctccagtatctctgattttgatgccatttgtctctaagtcttgccacagagctactgctggtcttacctgaacacatctgcagattcgttttccctgtctctttccaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatgggtaagtacttctccatgtccaaaattgattttataccaggtgatttggcttttggttacacatttccagagtctgtgacatctacttacaaactcatgattgtcctttaatcggtaggtccaggttgagcaattactactaatatcccttaggtagtgtcttgggtactgatttgtgggtccctctgacttccctggctagtggcccttccagaagccagaggaccagctgccagagtggggatttcatgagtgggtgttaaagatgttcatttcccaaagttcagatacagccaagaagaaaacagtcaaagaaatgttaaaaggccagaatgaaagtaatttaatatggtagaaactgggttttaccagcagaagttgggcaggaagggaaaggacaaagtactttggccatccaagcgggttctatgggagtttggtaccccagagcaggattagtcatggatactacgccaatgtaattcagtagagattggaacagagctttgtgctacaaccaccaagacatatgacagtggaatcctctaagctttctggagatacttgcttactcagtgatccatcaggcctctgcggtagtgacattggaaagcaaacttaaactagggcacttctgtgcctggcttttgtttttccattccataagtataaataccatcctatgacctcagcgttgagggaccccagatctgattactttagcaacaaggatccttctttgtgacttgtttacaggagaaaaagcccaactgtctagctatgcttagacttggcttccttctaagagaataccttttcagaagggtcccacctgaacgataactgttacccattgtccatccccatggtgtgcaggggagagatcctgcctgttgctttggcaataaggctgaatggcctccttcgtaatttcttgaaagtcttctccccactcccagccattaacccatctgtatttagttgcacttagaaggactacaagctgctgcagtctcatcaggaatgaaatcttgacatcaaaaagaatgctctccccattcctaaactcatatccatcttcttgcctctgaaatgcctctctgggctggctgagaaggtcccagctaccaaggactcttgctctattcaccagatatcagtgtggcatagcaggtgtctgggctgccccttgtttgggaccagctatcttctggcaccaagcctccctccagcacggcttctctttccagtaagaagcctggatgggaagacttcttatctgagggcagggctatgtgccatcctataggtatttgcccagcctcatattctgagagctgcatattctgacttatcactctcaacattccttccttccctaccaggactggcagagaccagggagtgctgcttgaggcttctgagccctcaggcatcagtccattgtggtgctggtggcgggtgggaggattcactgatgtggctgggagaggtggagttggagtctgagaatacccatgagtgtgagaaaaggtgccagaggggtttcagcacttcttgtgtggcctggcctgtttccctgtgtagcatagtcaggaaaataactcctcgggtatgactggccatagggccttgcaaatagtttttccctctttacctttctatgctcatataggaagtcaattctcatttaaaagaggagaaaactgaggcagagagaggaaataggaagtgatgtggtccaaactggactctttccaggagacctgaagcctcttagggagaaagggtggagttgggaaagagaaagggaaatatgaaagaatcttgcaaaaaaaaaaaaaaaaaaaaaagagcgattattttgattatttgatccttcaagacaaatgagccctgggacttgccatgtcagtgccttcaggggcagccttccctccacatgatgccatggtcacctgcctcaacgtccacctggccacccaacttatcctcttcccaaggcaatgcctccatcaccagaggagctgctctgtcctctggagggtgtgagttgagcaggagagaggaattgggactgagctgaggcaaattcagtgacttgatggctttgtctggggcagagtttagtgatgagctggagtgattccagatttaaagatgcctggaccagcctcctcacctcccatgagatctgtgtggtgagggtagaaggtggcagcagaaaggacaatcaatggaccatccactgcagcgcagagctactcttgtgggtgccttggccagctgcaaggaacagggcatttgcccagcaaatcaaaacttgcccagctttgcactgttcagagtttgggatcacaaaggatggagatttgcctgctctctgattatggggtcgctgctagtctcaagaatctttggatttgcagtactcagcagtttgccttgccgaaagcttgctctgtttaatgtcagagatgacctcactagcatagtgctcagagcagcgagggggacacagtgatatcctggtgatgttgaatgtgatgattacgaatggggctggcttcctctcataacaggagacggtggtttggggaccactatttggaaaacaacattccgtgtttgtagtaacgagggaggaagttgtaataataaagtcggctggggagagcctgactcagaggagtgggctgaggaatgacaagtcagacgccaccaagttccccggaaaccactgtgtcgtgagcaggtggtgccggctgtcgtgcacgggtggggcaggagcagcagactggttggaagcacccggaggcagaaggcaggggaaaggcagttggagaagcacagcagctgctgccttcctggttgcctggaaagcagcagagtatatgaggtctaatgaatcacagagcatgagtggccacgttggccaaggctgccgggctttggctggagtctcgcaggggacagacagatgagtgcccagcctgctcatctgcatggccagaatgaccagagaagcaaggaagcagagaaataggggctaccaaacagcctaggcccggctgatcacagagtcacataggcataggacatcttagctagaaattagtggccataaagtccccatgaactgaatgaataggataatacttatgtaaaatggtgagctgtgaaatggcatatggaaaatggctcgcacagtgcctggctatcattggcactaataagtgctaggtccttttgggttcaaacattcatctcaccatcatggattgagtgcctcttgtgtggcaggtgccaaagatgacacagccaaagacaacaaggtcacagctttcaaggaacatctagtccagtaaggaagacacaagcagaatagcaacagcacatgcttatgtgaatgttttaaaattgaggctcgtattattaagaggctgagctaagatcgctagtggcagatccagcagaagcagccggctagggagccacccactgcaccacactgccattctgatgtgtctcagaagatcaatccagcagcaattgtctgtgtaaaattggtcctctcccggatgcaagaacgcaagcttgatggtgggtggcgtgtagggctataggagacactctccagggctcctacccagaaggccacctcgtgtcttgtttcctttcgaagcacatgactttttcccacagcagcgggtatctggggactttattatgtatgaccagaactacacagtgtgtggagggaagaattgggcctcaaggggatagaagttgccaatcatttggattactaatacttgaaaagatattttaaaccggaagtcgttgaggaaactcaggcttgagccaagataagctgtcagggcattttaaagcacaaataagcctcagtccagagggtggtggtgaattgaaattctcagcacaaagccttgcctttctgcaggacctcaacccctagacccggaagatacgggagtctaacctcctcccctttccatgttggtttcctgatggggaacatgaagcccaggcgggtgatgtgatgtaatgtgacgtgatgaaggtcaaactgcaggctcagacccggcacaatggctcacacctgtaatcccagcactttgggagaccaaggcgggaggatcacttggggccaggagttcaagaccagcctgggcaacatagcgagacccccaacctctacaaaaaaaatatatttttagttagccaggcatggtggtacatgcctgtaatcccagctattcatgaggctgaggcaggaggcttgcttgagcccaagaggttgaggctgcagtaaactgtgatcatgccactgcactccagcctgggtgacagagcaagaccctgtctcaaaaaaacaaactaagaaacaaaactgcctgctcgtggcaaagccaggactcatctccacagtggcaccctggaaaggtctgtttcccagctgcccagctgcatcaggaaaccctcaaactcactgcccttagattaaaatctgcagccaccctccccaagtgaagaaaaatttgcattcatgctgggtacccacacagctgccgcgcttacttaaggcagtcagttctgaccaaagatcccagctttaaaaccagtagcaatcctaataggaaatgtgccaaggtaatttaactcaaaaagatattgatttgtggccatcaggaggtatggtttcaatcctgattccaccgctaatttgcagcatggttatggacaaccacagtattgcccagccgtagcttcttaccttctaaagtggaagctctggttgccctctgctcccctcttctgtcctggcaatgccagcaacctatcctcagatgccatccaggactagggcagcaggaagtaattctccccaccccagactcctgctccctggacaaagaggaacctccctactggcccactgataccttcaccactaatgcacagaaccctggctgttcctgtcagtagacaggccaagcgagagatggtctcagggcagggcacctgtggaaagatgccaccaggtatttgcttctgaaaagggacctgattgcttttcccaggctgctctgggttgaacttcagtcagcccagtgcaatgtggcaagtcttgacagctgaggaaatcagagcctgtggcattcagcctccatggtcaaaagttctcttcgaatcttgcctgcatgataaatgagatcagaaataaaaaaggtgatcatttattgaaactgatgccctcaagtggcagtgtcacaatgatttcaggcccagctttttctcactttcaaagtcattcatagagtcagcttctctcttttcccccatggtctgaataacacactaataaatatacaataaggcctttaatgtctaggtgatttacactaaaaagagagagccattcaaaggctctaaaggtaatttttaaaagccttaaaactcacacccaggcttgtcagggggatatttctcagacaccttgttacaggagcaatcacgtagctcgaagttctctgagcacacagtgggcaggagacttgagctctaagtattcttggaggaaattcttcacacacaatatgagcttggacaagtctcagaatctctacaagcctcatctttgtcaaatggtagtaattgtgccactcacggggttgtcgtgggtttaaattagatcaacaagcagagcaggtgctgatagtgcctaaccccctgcctcccaggctgtctgtctaagggacactctcctctcaggctgctcagggtcatgggagagtgggcaggaagagagccagggttacagatttcacttaaacccctccttctcagagtaaccacttgtgttctccaagatagatcccaaagtaccagtcccattgagtatacctggatttaccatattcctccccactttaagtagtaatattgaagcaactactaaaatgctagtcctcttaagaggaactggaccttcagcgattaacatagtaggtctcaagctttagtaatacaagtgagaactacacattttacaaacttcatacaattgagtctcatcttttttttttttttttttttttttgagatggagtcttgctcttgtcacccaggctggagtgtagtggcgtgatctcagctcactgccagcctccgtctcctgggttcaagtgattttcctgcctcagcctcctgagtagctgggattacaggcccccaccaccacacctggctaatttttgtatttttagtagagacagggttttaccatcttggccaggctggtctcaaactcctgaccttgtgatccacccacctcagcctcccaaagtgctgggattacaggcatgagccaccgcacccggcccgagtctcatcttgagctattctgattttactcgtcttggagtgggccatgagcatatgtatgtttagaaagctctgcagggattctgggtgtgcaccaaaagttaagaatcatggctctaacatctcagcttgaattggttgatcacataagcgggtagctttatataaccatttactaagcactaggaagaaaagtaaaaaagaaagcttaaagacttgggagggacttgtgtttaaggtggagagccatttttctcccacttatgggtggacaggctagtgacaaggtttccaaccctggcctaatcctgcctacatagtccctgagctgaggtagctggagggtatccaaggtcatgaatgtcactggtctccacaggtggatatactcctgacacatctgttattctgtctctagaaggactatggcttccaaagccacaggggaatgagaagaatacagatggactagagaagccaaacctcttaaagccagaaggaagctccatcccattcttccatttaactaaccatccatccatccattcatccaccaaccatctatccattatccatccatacatcccatctacccacctatccatccatccatctacccatccatccatccgttcatccatccatccatccatccactcatccatctaccatccatccattcatccatccatccatccatccatcaatccattcatccattaatccatctatcatccattgatccatccatccacccatccatccattctctttgtacttcacatattgactctcatctaggtcccaggttaacaacagagccacagccctcctttttgttctcatgaaacagatactatgttgttaatattcatggtaaatatctgtacagtgcatgttcagtttgccaagtgagtcaacctctatcaactcatttcacctttactatgatctgtaccattcatattattcacctcctttatagaagagtaaaccgaatctcagagagcttccataatttgcttatagtcatgggtaacacagggaaacagatcttctgggtccatttcttttcttgtgttgttttcccaagaaagccttgcagttgaaccttggcgtcacgcctggctccgaggaaactaagagctgttcttatccagtcaggaaaagctcttctcaggaggactcctctgaaatttggtcatctaattctggcccacaagtcttgaagatggagactttgggttgcacacctttttatgctagcaatgtctggcacactgcctagcacatagtaggggttctatattaggtggatggataacatatcaattgaagctagttctaggatgcacctcttctaaagcctaagctctgggtctaaaaattaaagccccgttcaagatcacagaagagtctccaatcgatgaaaagatgaaaagtattttctccctgccctccacccacacccaggaataaatgtgcaaccctccctggggctcaggaagcagctgtcaaaatgcacctcaactgtgaaggttgtcatgaagtacaaaggacaattcctttcctggcaggtacaacttttactcacgattgctttcattgatgggcataaaaaaaaaaaaaaaaaaaaaaaaaaaaaaaaaccttcagcttctgccagttctgaccttcgagatttgacagctgaaggcttgtagtgaggctcttttgagctgctgcttttgctttctcactctgccctggatgtttgatggattgaacaccaggacgatgagagaactgtgaatacctgtaaccccgtgcttgtcagaatggcatcttggccaatcccataatgataaatatatattgtatacaaagagaagtcaaaatgcatagaaacagacacttctcatctcagaagtgtttactgagcctcactgtttcccagtggggagggagatggtaaaaataggtgcaagaattttagtgatagaacactggtgtcaagaaattcactcatagttcatgtatgcattctgtcaacaaatgtctatgagtcatgctcagtcccaggcactggttggactctggaagctcattcagccttccaggggctcagaacaaggtttggagttggacgacagacacagttatgaggccataaggaaaggggtgtaatgggtgctgtgcattgggtgctatgggaatgcttgtggctgtcaggcaagctagccctgagaaggacacttgagctggctctgcaggggcaaggggtgtcaggtggatgatgagaggaagacattccacacagagagtgcacgtgtgcaaaggaccgcctgaggacacagatgatgagctgtggccacgtgattctcttggtttcttcctccccctcctgcccggggttccttatcctggctctctgagtgctcactttcatgtgtttgtggccactggcttatgtagcaagaaagcccatccctctccacaaaagcagtcctcagacagcaaagcctcatccctaagccccacaatcaccactacctcttcttgtagcaaatgtcctgctgcaaatgcccagaagacctccctctgagtgcaggctctcccctcgctttcactttctctctggtagtatcttcttccctaacgaaaactccaagtacctatatggacaatctgtgcatacaactattttttacaccagcacaagtgggtttcagtggatgagccaggactccaggaatggcctgttgtcccttcagtccccactttgcaagaagagtagccatggagatggggtgggggttctttgtggactgcccttaaccccttttccactacaaaaacccctacacatgcaatgtcccctcctctgagaagcccttttagggtttctcaaatagcattgaccatgtagccttgtgaccattcagttaccagcttgtctctccctacagtcaacagggacccagggtcctctccctgttgactcataagtgccaacacatgaaagacagggagagaatgaggctgctggctggggacgggacaggacctggcatcccagataggaattcacgtcccttccttcattccccgtaatttgtatgataatgaggaagagaaagaggaagaatcacttgatgcttactctctggtctcagcattgttctaagtgctttgcatgtgtcagctcatctaatattatgtgtaccaccacttggtgagggaggccctagcactactacttttacagtggggaagctgaggctcagtgaggttaagtaacctgcctagagttgcacagcttgtaaggagtagactggatctgagcccagctaatccagctccactgtccctgctcccaatcaccactctatggatggtaactaccctattgccagctgataattaaggatgcagtcttatttatttatcattattaaccattatttattgtttataaatcccagctgcatttttctatggtgtgcatacagtccttcctgtccgcaataaatggcaaagttataaggctttgatgcacagaagaggcctgttttagagagcaggcagtcctgagacttatgtctggcactgccgaaggtcatagagagcctatccagaaaggctggcctccgctctcctgtcttctgaagctccattccaacccagttgccttcaccttcaaaaaccaagtctgcattgaggagatggaatcgggtgatggaattgccagctctttgagccataaggaaactgtccaggcaactggagctgatggcccaagagtgaggaaacaccatgacccacttagtagcccagttcccctctgcattcatgcccagcctcaaagcaaacctccttctttctcattacttggcctgtttctaagtttgccttttcctctttgttttatttagggaacgacacacatatgcctggctaaactccttgcttttacagaaatgcattctcttatggttcagagccttagtgaagagccatagcagccttgggattttgaatttaaagggcttcacaaagtctacacaaagatttggtgcaatgtctattcctgggagaatcttacatcagtaagctcagtgaatgagtgttcccactcctttccaatgactgattgtgttccccctgccagtggggaagtcttgtggtggtgagaaaagggagggtccctaggggaggccactgagagcaggctgagcccagggcatgagacctaccattgccagaagctgaagatgtttcttcagatcactcacctgagggcaccaggttacctgaggatccaggaccttgctccaccctatagggcaacttagctcaaatgatgcacacataatgggagtctaaggaaagacctgtgggccatgctgcttttttcttagccccactgtgtgatccaggctttcaattcaccaaaaggagtgtgaaggagaacccacagtcaaattggtattttgcattgtgctgttcattctgtgggacgttccttgcagtcctagaatgatcatctcagtgacttctcctggccatcaggaagccccatgttggaataaatgaagacccggatgagagaactgacaagtgaatatcacgggctgttaatcttcagcctcaaatcctttaggggatccctgtgaaacccaggatcaagtctgagctgtttattagtatggcactcaaagccactgatcaagcctcacccctcctgagcctggctcaccccatttctctggacccatgattcgtttgtatcaaactacccacagttgcccccaagtgaagcaagccagttcaagccattttgccttccctcaccttcccgaccatcaagaacaataggtcttctcctccaagaaggaatctcttagctccttttccacaaagcctttcttgagaccccagaccttctgtgagcagagctgattgcaccaccatttgctgcctgttccacatctctatgagtgttctcacagccctgggccacatttgttctttcacatgtcttcctcaccaaccaggtaccccaagaatagggatgggcattatttatcactgtatctgcaatgcctagcacagtacttgtctcacagtcaataaatgcttatgaaatgaacaaattcccaaattaattggaccagaaactctttgaaaacttgcgacatggttttaagaatgcatctataatgctcttgaccaaaattccatctctgttcttcataacgactcacttccttctactcaacctccaatcgaaggactgtcttcagcctgggttatctccatttgtggccttaaccatcctacactgccgagcaaatgctggcctatgttagtcttggaaatgaggtggttcccatgcttggtgattgccctgtccgtgtgtgccttttagttcctctaatttcctgagctatttcctgcatatttcctgttcttccagtcaggacttctacttagtaattttcccccaattcctccttctccttagtttactagtctttacatcaccacttaaccacactgacttctgttgagtgttttatcttttcagataatctaagatgaattccaattacattctgtccaactgtttcctaaatattccctccatgattttgtttctctgtcttaggactaaaatttctctgtgactgcatgaaattctaatcggcagtctgctggatgttcacctgcaggcctcagagtgatttccctatctggagtcttccagcctttctcgcagtggcctggtcacctgccctgggagcttcctagtgaccattggctcatcctctcagtagatccagatgacttccatttctaaaaagcctcacttgtctatcaactttcttgtttaacctctgccaccttgtctaacttacggacagtctccagggttccaggaggtggtggcagcaggtacattgtgtgtgggatgtgagccagaaaatgtggttgttggcaaagccagaaatcagatggaaataaaaactcctgtatttcatcatatacccaaggtccttagttcttggccttcacccatgactgcctctccaatttcacaatcctacatgactgtttgtgggttaaaggcataatctagctagcagaacttgaaaaatatttcaatcatggaatcatgaaccagaaatgaaccttaaaagtaattgaattcaaattctttatcccctaccccaaaacaatgcaagaggctcttccaaagcccatctggctttgacttgcctgactccagcagtagaatgctcaccaccttgcaaaacagatcaccccattgtacagcagctttagctcccaggtagaacttgctgatatccccttggctttgtaactttggaaaggtaatgactgtctctaaaaagttattcaatatctccaaacctcttgtgttttatacacaaaatggcaatagtaatacctgcttaccttgtaggctctttgtgaaaataatgcttttaacaacgatagccaatgtgtatagagtatttaccatgttcttaatacaaagacatatgatttcatttaatactacagtttccctatgaagtagtactatgataatgcatacaaagcacctagaatcatatcagcacccaacacatgatagttccttctcctatttcaccatgatctggttgatcctctatttgtcctctagagtcatacagaggaagcttactttctcctaacaaggcagtctgtcttccctttgaggatagtttttatatctcttcttcacttgttttcccaggctaagtgattttagtctcttctacagcatagttgccacagccatattgttcagagggattcttaccagcaaaggggtcaggggacttgttcttcagtgatctggaacctccacccgctgatgtggcttaagcctggctcaccctttcgctagctttattctgcgtttgaaccccagccacctaaagttgacaccgttaggaaccatgaaagctgctgtagcatttcactaaaaccatttcttagactatttgattcttttttctgaatggagaatcctcaagtttttcttgcaggcaaagaaggcctttcttgtttgctattgacattcccaaaaatgtctgattcggaaagaaattcaattctggccccagctttcacatcatcttgctttgtttgtcatccctgtagcctgccagctttgcccctttgttcccctaattgccagagacatttttatactgagtaaattgcatcaggcccactgcaaaatgaatcaatttgggaagagtatgagctgcactgttgtcttaagtgtgcattaacatttagatgcgttatttaaaatgggcctggagttcatgccagagagactgcctcatgcctattctgactcattctctgctattggactgcacagaagggaactggggagccctacagcccaccaccaaccctgttttattctccatatctccagggagggcttgaactaggtgagaacttctaagagctcagatttgggaagtaaatttacaaacggagtttgacttggtggtctcagagtgaagtaaagacaggtgaaggaggagatgaaggggaggcgaggttctccttctctgtctgtcacacaccatgcacacacttgacatctagctttaaatacaaatcatacggccagaagtctttggaggtaaaacaaagcatacacaaaaacacaaaggacaccagccaacgctgtagtttaaaaattaagtgatgttctggaactggtgaaaaagcaaggctgcaatcctgataatcatgtggtgatttgatgagataattcttttatcatcaggagagtcagataatatctccattagtagcaggaggtttaaaaattggagagagtggcaacaccaggacaatagcctgattaatgctttttcaatcacctgggctcatggcctaaactggtaatggactccatccatcaaaaaattattctatctggcatcctggtttctgaagaaatctggacgtcctcatagaggattggttaaatgatttaatgtggatgaaagctcttagcacagtgccccagtaaaagctgcttgaatctattccgtctattttaatatatgttcagagatataatgacccactagatacacaagagaaataaaatgacagttgtataatgaagatcttgaagctctgagatgtatgattatcagcaacgtaaggatggcaccttctgggggagattaacctggactccccgttcctgagggtcacttctctctgtgctgcccctaaacctctctgtatgtgacagccccagtcccatggaaattcactggctgtgtgtgtttctatccattttttccactacagcctcaacttcatcaaaacatacactgaactttcattgtggggtccccaaagtccaaaagagtgcctgacacagaagaagtattcaataaatttttgttgactgggcagtatttccaaattaaaactcaaaattagtgtcatgcgaatgtgtgagtgaaagtagatgatgataaggatatctgatgtattttgtgccaggcaggcctgaaacagtagcatccctgaccagagatagaaaacaagacatactcactgctaacatactcactgctaacccagctcattgctgtcaaataacaacagctaccacgtttatagcacttactatatgctggacattgttctaaatgcctttacctatctttacccatttaattttcacaatgggcctgtgaggtaacatattattatccccatttcacaaatgaagagactgaacttgttcagtcacacagctagtaatgaacagagttgggatttgatcccacagacaccactgcactatatgatgtgacccctccagaagagatgtagagaggtggctccccactattcctcccccttagcaggggacttcacagtggccctggcaggtgacatgccagatgcacagggaaaagtacccgtgagaagagaccatctccccgacatgtaccagatggaacagcatctccaccacctacccagtggacccccttcgttcagctaccactaggacctgggaggcaggatcctaggcaaagcctcaccacatatggtatctgtatgggaaaactgagagcagaaccattgcaagctggagagatgtttcatgctgtgccctgtttcaggacaggtgtgggggactaaaggcagtgtctgatctatactcccaccaaaccccaacagtgcacttagcagaggagttgtttcattctattcataggtaaaattgggtaatgaaccactaagaggagagacatgtacataatgtattcttaggtaaactgaggcaagatgagggtgactgagtctgcatgcattctgctgccctgcaggagctcactctgaacacagacccgactccagcactgtcactgtcagagccctcacccaggtcactggacccagaactcaccttagcccactcggccaagcttgagctggcctttcacagctgtgtaaataggatttccaaaatctccagaggaagggtgaaaatatctccctgttttctaattggcttatgaaaacatcttcctctaattgaactttcccctcttgcctgtgccttttgatgcctatacttaattgtttctaaacaggaagctagtgtgataagaatttagttacatctgcatcttccgtgctgaaactattttaccgtatgcttctaaagttggttacaggttgattttgatgagagtaatgttaagtcccaccagttttgctataattgatagtctgctacatgattggggaaagaaaattgtttattgatttccaattcaaaaaggacatctacaaaagtgtttcccacaaccacatgatcccattatgcctccccctatccccacccctaccatcttggtgaggtcttaccccatggatcacccctacccttcatcctatccaggattacccatctctttgccttcattcactcattcatccattcagtcattaaatacttatttcaatacgaattcctctattatgtgcagggaaattagctagatggtgaaaatagaacaggggacaagcagaaacagtcactatcctcaggaagctcacatgctagagagtgaaatatatactacattacaattatatgtataattatgtcattgccacagtgatacatgacagaggggtacaggcttgcaggagctcttgcaagtagggacctgagctaggccaggggctcaggggagccttcccccaggaggtggcatttgaactcaagtgtgaaagatgagtagaagtgacaagtagcaagaccctttctgggagtgggaacagcatatgaaggacctgaagggaaagaggtaggatattttttaggaaatcagggaaaacatgcatctgagtctgaaagaaaagaggagactggctggagagaaggccaggggaaaggacaggcagaggactgatcaggaatatttaggatcataatccttatcttcaaagccaaggaaagctgatgtagagtttaaggatggaactgcaagtcagttggaggtagggtagggatgggtatgggaaccccagacctttgcagcaccacaaggaaagggagggtagtcctgaatacagagtgaggcatagagaaaagtgaatgacttgcagatatgtacaagagacaatgggcaggattagtgatgggttggatacaggtgggaaagaggagaagatatttttagcttgaccaactgggtagacagagccattcaccaaaacaggcaaaaatgacggaggcacatgtgtggagagaaaagtacaaacttcagttttgagatgttgagttttttgaaacttataaacatccaagaggaaacgcatgtggacacaagggtctggagtttggaggaaagatgtggaccatctttccaaactccaaaaaccaggagttgttggcatgcaggagtagtcttcaagccctgggagtgtattaaaaggtctaggaaattctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttggatatatacccagtaatgggatggctgggtcaaatggtatttctagttctagatccctgaggaatcgccacactgacttccacaatggttgaactagtttacagtctcaccaacagtgtaaaagtgttcctgtttctccacatcctctccagcacctgttgtttcctaactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatttcctttgcccactttttgatggggttgtttgtttttttcttgtaaatttgtttgagttcattgtagattctggatattagccctttgtcagatgagtaggttgtgaaaattttctcccattttgtgggttgcctgttcactctgatggtagtttcttttgctgtgcagaagctgtttagtttaattagatcccatttgtcaattttgtcttttgttgccattgcttttggtgttttagacatgaagtccttgcccgtgcctaagtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagttgaagtcaggtagtgtgatgcctccaactttgttcttttggcttaggattgacttggcgatgtgggctcttttttggttccgtatgaactttaaagtagttttttccaattatgtgaagaaagtcattggtagcttgatggggacggcattgaatctataaattaccttgggcagtatggccattttcacgatattgattcttcctacccatgagcatggaatgttcttccatttgtttgcatcctcttttatttcattgagcagtggtttgtagttctccttgaagaggtccttcacgtcccttgtaaggtggattcctaggtatttttattctctttgaagcaattgtgaatgggagttcactcatgatttggctctctgtttgtctgttgttggtgtgtaagaatgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttcacctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaattcctaatttattgagagtttttagcatgaagtcttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctagacctaaacaaaatctaaagctattataacatttctggaataaaacataagagaaaattattgcagacttgggtaagaaaaaacttttttagatagcatacaaaaagcataaactataaaacaaaatattgatcaataggaatttatcaaaatttaaaacttttaaatattcaaaagattccatttgaaaaatcaaaatacaagccacagtgtgggagaaaatattagctatacttacatctgaaaagaacttgtacccacccaattaagtgggcaaaatattttaatagacgttacactaaagaagatatacaaatggccatgaaacatatgaaaagatgctcaacatcgctagtcattagtaaaattacaatagctaaaattagaaagactaaccataccaagtgttgttaaggatataaaggaactagaactttcatatactactggtgagaatacaacatggtataatcactttggaaaaacaattggaacatttctttaaaaactagacatatgcctaccatacaacccagccattctactccctgtctggacatttactcaagaggatgaaaacgtatgtccccacaaaactttatgcattaaaattaagagcagcattattcacagtagtttaaaactgcacccaaatgtgtatcaacaggtgaatagataaagaaattgtggtttatctatactatggaacactatccaacaataaaaataaataaaatactgatatatatgataacatggatgaatctcaaaattattatgctaagagaaagaagccaggcacaaagaccacatagtttgtgcttccatttatatgtaattccagaaaatgcaaactaatctactaatctctaatgacagagagcaaggcagtggttccccaggaagcagggcaggattgactgcaaagggacaagataactttttggaaggtagagagagggttggagatgatggaaatgttctatatttggaatgtagttgtggtttctcagtgtaacaactattaaaactcatcaacctgtacactttaaatggataccatttattgcacataagttttgcctcaataaagctgacattttgtaaaaatacctagaaaaaagaggtgagagtaaaattagtgaaaaggagatgaggaagtgatacatgtatgtacagacaagtgcattgagtgtaagggtgaagggctagtgagagagatggtggcagagcagagaggcaaaggatcagagcccacttatttagccttacctacccttcagtctgccttgcacagtgcagacacagctagagaacatgagtggtattcctgggcctctgattcacgaatcaccttcctcatgaagacttctcagaaaacatcagcccactctgttctcttcctctctcaactctgtaaaactgtctagaccacaaaataaaactccagtgtcccacctgatcaggtaatacctggaagttgttcaaccatactctgtttcctcagtctataaacatccaatactctctttgtttgcaaattgttttgtataggtgtttctggtttccccaaagagactgttgtttcactattagttattgatttctttttgctgcaaacatattataattattgtacacaataaatacttatagcagcctatgaagtaaatactattaatttccatttacagcaaataaaactaaggctcaaggaaattaagcaacttcccaaaaaagatgaactgagcctattcataatcattgtagaaacaagcttcttctattttggggccatgttttatgctttgttggcccaccattgcaagatgctaaacaaatattggtttattcattgattaattccttcaactattatttttatgatttaaaatagcaaacacctgccatcagggactcttaaggggacttaagaatgccaattgctagggacatttcatacttgccagaccagatgaaggaattaaaggagccacaggttttgtgtcactgcctgggtgggatgaaagaaatggagtcagcttcctcctctctgcttacccagcagcctttttacttcttctaggatttcttctccttccctgtgagagaagccacaagaatgtcagggactgtggccacctccactggccaccttggcccaaacccagtgtcaagcttcctttacacccatgatcccataggcaatcctggactagagagtggtaactaaagccactgggtggtcattcttcttcttacaaagtgccaagtcccaaacctgaaccacaaacagatcacaattgctaaacctaaaaactacctttcgattgccttgtaaataaagccccctctctagctctctttctctttttaaatgcttctccccaaccctacctttattctttctggttctccagtgtccccaaagtctgcactataattgcatatctaaaaggttattttagttgttgtaaaaggcattccattagaaataaattggaataaaagaagagagacatgttaagaaatatagattccaactatgtgtctttgatttttgcataacttagggtgagtcatggttctttgatgaagcagttggcagaggaggtaaggattcattcatgaataaaagtataaaagttcctaggattcatgaggactcagagagagatagttgcctggaaggtagaaaggctcttttcttccagatttcagacttaatattcactgaaaagcatgagagaaggagggactgaaagggattgtacaagcaagtacagaaagctttcgctgatctaatttactcttaaaacagccttctccatggttgaaggaacccctgttctccttaagcctttctatctcagctacatttttgaaaaataagcttcttttaatctatcaggggaaaccagggatgtgttgaggatgcttctgtgagagatgaagccgaaatcaataatgctgaaaaaggtcaaagctagaattgttatttaaatgttgagtgtccccaaatttactacaagttgcttataaacatttacaaaattgactctcttttccctctagaagtttccatgacagaaaagcctccacacatgaccatgggcacctggtcttctcatagcagggcttatgtatcactgttcccctccgtccacagatgggcatacctgcacacgctactcacatccatttctttttccctttctattaaaataaaaatacacactgaattagaatcaccaagaaaggagcctgggcatctttttaataatgcacaccttgatgatctccatgactgggcacgcttgggagacgctgaattagatggcttaagcagaacttctcagcatttgttgtgcctgtgaatcacctggggatctagtaaaatgcatgttctgattcaataggtcagggatgggctggaagtctggatttctttttttttttttttttttttttttgagttgcagatatgggatttttttgggttttttttttattatactctaagttttagggtacatgtgcacaacatgcaggttagttacgtatgtatacatgtgccatgttggtgtgctgcacccattaactcatcatttaacattaggtatatctcctaatgctatcccttcccgctccccacaccccatgacaggcaccagtgtgtgatgttccccttctggtgtccatgtgttctcattgttcaattcccacctatgagtgagaacacgcggtgtttggttttttgtccctgcgatagtttgctgagaatgatggtttccagcttcatccatgtccctacaaaggacatgaactcatcattttttatggctgcatagtattccatggtgtatatgtgccacattttctgcatttctaacaagctgacgcctatactgctctgaacagaccactttcagtagcaggagtcagaaaggaaatgcgttgggtgtccacatgcagatgttaactgaagctagaggccagaacagtttcagagggtccacgtgtactttctgcttgccttgaacatcagatcagtgacggtggaaaagcctctcaagaaagccagccagaccctgtagggtggcagtttctcagtgcactccccaagttctagatcagaccctcagtttggtggggccaaacatgctcaggactcaggctaaccacactcacgcaagacatgtaagtcatgaataggattttgaaatgtccaataaaacatacagtgattggtgtgaattcactccttgaccaatcagtgcattctctgactgccggcagagccacgctgggggccaagataactgattatgatcagtaggtggtttggtgaacaggccttcagatacatcaactcattgacatcatggcccctctctgtaccatgagggccatcttaagtcaggactcagtcagcttgtcctgcctttcctgctcctattctaggaagttcttgcttctctagatttgtttgtgttcaactcattattgcatcctaatccctcctaaaccccaggtgctatcctgagcacagaggccatagaaatgttaattttagtcaaaccctgctcctcctgatttgggcctggcctggaagtcatttctgcctcttagttttttccatttttaattatttaacagtggtaaaatgcacataaaatttaccatcttaatcatctttaaatgtacagttcaatagtgttaaagtacattcacattgctttgcaactatcaccaccatctatctctagaaccttttcatcatcccaaactgaaactgtgtacccaataaacaatagttccccacttccccctacctccaaccccaggcaaccaccactatactttctgtctatatgaatttgactactctaggtacctcaaaaatgtagaattcgatggtatttgtcgttttgtgattgacatttcacttagcataatgtgctcaaggttcattcatattgtaacgtgtgtcagagttttcttccttttttaatgctgaataatattccattgtatgtatataccacatttggtttattcattcatctgtcaatggagacttgagttgctttcaacatttgactattgtgaataatgctgctataatcatggttgtgcaaatacctcttcaagaccctgctttcccttttcttggatatatacctagaagtggaattgctggatcctacggtaatttggcttttaattttctaaggagttaccatgatgtttccatagtggctgcatcattttacattcctaccagcagtgcacaaggattccaatgtctctacatcctcactgatattttcacctcttcctttaagtgtctttgtcagttacaagctgggtcattccccagtgtcccacccaaaacactgtttcggtcttctttaccccatccaaatcctgcttaactttttttttttgttttgtttttgagacggagtcttgctccgtcacccaggctggagggcagtggcacaatctcggctcaccgcaagctctgcctcctgggttcacaccattctcctgcctcagcctcctgaggagctgggactacaggcacccaccaccaggcctggctaattttttgtatttttagtaaagatggggtttcaccgtgttggccaggatggtctcaatctcccgacctcatgatccacccgcctcggcctcccaaagtgctgggattacagacatgagccaatcctgctcaacttctaaagctaagtctcatattttctaaaaagtgcaaagcattatcccctgatgagctcaccctgtttatacctgatcatgagtgtctcattctctaatcgccttctattaccccactagagatcatattctatgctccttggcttgatctagcagtaaaaagcaattggtatttgttgtagcttgtttgatagaataatataaagaaaagcaagaaccatgcagaattggaaaaagggattaaatgcccaaagtttgatccctgatctgagaactctgtacaagggcaaaggaaatcaagtcctcttgccaccagaaaactatctctcgcagagacttacgtagagcctctgtacccacctagtcagccgttccttcctggccacagttacctaggggatcactggccctaaagatcatcgggtgaggtgagatgcctctcagaaaaaaactggctctggaagagctagccgcaaatctgtagcaaacctgaactcattatttcgggggattgctgcacgagtccatgtgggttttattacaatatatgcagccacttacattatgtcaggcctgagttttcttctatattcattcaccccatgaatggatgttgctgactgctgaaccaaaccaaactgactttttttttttttttcaattagtgtagctgccttagattatggaaagagctgaatggtgctggtgttggccttttagaatggtgatttctctgccattccatgaattatctgatgtggctgccctgggctgccctgcacccatttattggtatgaagcaagtgcctgaagcctacagccactgtaaacagggcctgggacaaccaggagcccagtttcagggtcctttcaacctcttccacccacaacaaggtttcagtcatctcaggagtgcctggcctaacgtagaactccccctaagctccccagaacctgatggaaccaggagtgctggcagaaggagatattcaggacatctagtacgacttccacctggcatttgaagcccctgccaagtacttatcagtccacttgaacttctcttgtaacaggaagctcaccgcccccaaagatagttcaatcatcttgagatagcacattcactcaggcaccattgatgacccaacagtctacacagcagcaggtccctggacccccttcccctcccccagaggcatgctgggggctgtgtggctcccaggcaacccatcagggtgtcccacccagtagagaattcacagccttctcacctgagaacccagagcaggctggctgctccactgagagcccaaaggctatcaatttactctcagcccatcttgcctccctcaccctggtccaattactaatgcctcccagataataactgcattttccttcacaatcctaaccacactggaccttggagtgaccacaggccacaagtagtctggggtctctgccccacctccagccctcatccttgcttgctcactgtcacagtcaccctggactcaccccatgcctccaggctccttgcctccccctctctacccagccgtcaaagtggccttctattaggatggtgcaaaggtaattgtggtttttcccgttggaagtaatggcaaaaaccgcaataacatttggaccaacctaataaaatgccagcttgactgtgttattcttctgcttagcatcagtcactggctccctatctgctatgggatcaagtccagccttgctgatgagcctcgaggtctctctcatttctccattttactccacccttcactgcctctctccttgttcaagcattacccaaggctgcgattcttcctcatctcctcttcactcttcaccccatatcccccatgagagcaaaccctgtcaattccatctccaaaatatacacttacccacttgcccctccctcctaccatcctagcccaagccaccataatctctcacctggtcaactgatacagcagtacctcctgactggcctttctagctccacttttgctcccttctttctctgcacagcagccagcataataaacatcaaaaatgtagatcaagttatgccagcaggccacctcactataaaacctttgcatggcttcccattggtctcagaaaaaaatctcagcctaaagccctgtgtgacctggctctgcccacctctctgaccttctctcacacagcgtccccacactggctgcccatctgtttctcctggccactggccctttgtactcactgctccctagcatgcaacaccttcccttggctctatactgtcacctcccactcatcctttggagctcagctggaaaaccaccacctcaggaattcccactgtgatctgtgttttcctctgtctcagtgttgtgtttagctccttttagcaccaccaacaactggtaattaattaatatatttggttccttgtttattgtccaaatcacctcactattaggttggtgcaaaagtaattgcagtttttgccactgaaagtaatggtaaaaaccacaattacttttgcaccaacctatagaaagaaagctccatgagggcaagaactttatggatctcattatatccacagtaacacagcactaaacaccattcatagcacttagtagaagctcgataaattttgttaatttaatgccaaataaatccagcccctgctgcttctccagtgttccttctgccacgcctcaccccatgcccacatcccagccatgttgcctgggattcctgaagatgcagctgttttaggtctctgccttcactcatgcccctgggctgggattcttaagccagaaaactccactgatggaaatgttacctcctctctaaagcatttccaggttccccaagcaaagtcatttgcccagatctctatgtgccatggtacggtgcccatgcattgttctttctcttggaaacttggttgtaatgatgctttttcatatctgtatcctctgtgagatctaatttccctgatgaaagatatcacggcttttccatctccaccaaccttcactcataatcaaatacagaacctggagcatattagttgttcaacaaacatttgttgaaatgatgaatgaattaagtggaagagcagtccctggatataaatccaatagaccagatccctaatcccagctccctggtaacctgagtgacccgtaataccacttgtgtctcagtttcttcaactgtaaaatgggaatcataatttgttacctatctatctcataagtcagtttaagatgaaaataaaatagtaaataccaaaatagtttgaaaactataaattcattcatttaaacaatatctattaagtccttactcagtgctgaggcacttgagttacaactgcgaagacatcatcccttgaagagttccacgtcttcatactggcatatgattactagttagttgcccaccctgcataaagacaatctaccctgaactgtcttagttcttggtctgcagcatctttgcattaatcttttgcttttggattcactgcatacctgtttactctagttttactggaggtctctgcatgcattccagctgtaatcacggctgaatgattccctcaccaatcctggttccacttcaagaaaactgtcagcagtacacacagcacccagcccatccatctgtgtaaagagataatgtaattctaagccaatatttaacattgtaggatgaggcataaactcaatatgctttcaggcggagtaaaaaaaaaatatgtgccccatctcattaatcacaataagaatgagggatggggcagatacccaggccggtgctgttcctccaagttaatctgtcttaataccaagcccttgataaaaagaatgcctgagtcattgttctgcttgtttgatggcaatttacattgggggagctcaagatttatgaagtaacaagaacctctgagtaataaaacgttgagtgatccatgctctgtttggaagtcacttctactgcaaacactctctggggatgaaacttcaagagaaggatttcaagagaagttatgcatttacaaaactgatcttttacaagtgcttattgggttcattcattcatccattcattcagcaaatcttaactatgcattaactctgtacaaagctctgttaggggtttggggaccaccaaagaagccagcaatggtctgtaccctcaagggactcgcattagagaagttgtgactcaaattcgttactaagggtgctgcatggactatatgcttcgcaagagcagggatgatgcctgttttattctccagcgtgtacctgtgcctattacaggacctggcaaagaggagctcattaaaaatttgttaaatggtaagtgtccatcaagagataaatggataaacaaaatgtggtacaatggaatattattcaaccttggaaaggaaggaaattctgacacctgctacaatgtgtgtgaaccttgaagacattatgctaaccagacacataaagacaaatactatacaattccactcatgtgaggcaccatatggacagaaagtagaatggtagctacccagggctgggagtaggagggaatggggagtgactgcttaactggtacgaagtttcaattttgcaaaacgagaaatgttctagagatggatggcagtgatcattgcaccacagtgcaaatgaacttcatgccactaaactgtatactttaaatggttgagctggtatattttatgttatggatattttaccacaataaaaaaaaatgttttcaaaagggctagcaagaaatccagagagagcttgaggcaagggatgaaatggagctttccacagagatgaggctattgaggggaacctgtactttcccccggaaggaggaagaagaggacatgaagcagtgctaaggacaccccctgggcatcctccaaagaaaggaggccacgggaagagtggtgagaatttgcaggagcagcaaaccagtaaggacatggaaatgaagcgtcggagagtttcaaggacagttctttcaaggatttcagcagtgtgcaaaggcctttggctttgacaagtaagaggtaacagatgacctctggtagagcatctccagagaattgtcggcatggaagtgaggctcacaggatgaatgccaagtaaatgaggaataagacattgacattcagtagtgaaggaaggggaatgatggtggggacttgaaagaatcagtggagaggacagaaggaagacttagcaagggacagagggactgaagagatgttctagaaggatccagaagggcttggaaggatgagctgggggagttcttctccccatgcatcagaggtcagtataagaagatgagagaagagaggtgtcaggaaaaagcaaggggaagaagagggtatttaagggctcctgggggacagcccagtctcccttctcagcaatgcaggaagcaagaccaagtgctgatagtgggaagacaagaatatgccagaaaggaggtggggagttggggactggggttgtgtcaatgtggtagggagcaaatcagagatgagcaaagcattagatccagctgagaccagagcccctgtgtatgcaaggatcccagaaagcctggagaaatggcagcattgggctcctggtagcctgaaggagaagagcgaagggaagatttaaccagctggggatggatgagacagggtcagcacaggccagaggaacatgcttctctagggtaggcaagaccatggatggcgctgatgtccatgaagttcctggatgacaaggaaagcagggagcagggaggaggtgaagtcagggactagagcacatgatgaggataaagggatggttccagaaaaaaaaagaagaggctagaccaggtagaagaaaaagaataggtggccattgtattagttctgagattaggtaatttataaaggaaagaggtttaattaggtcatggttctgcaggctgcacaggaagtatagtagcttccacttggcttctcaggaggcctgaggaaacttagaatcatggctgaagacagagggggagcaggcatcttacacggtggagcaagagcaagagcggtagcagggacgtgccacacacttttaaacaaccaaactttgtgataactcactcactcactatcacaagaacagtaccgaggggatggtgcgaaacctttcatgaggattccacccccatgatccagttgcctcccaccaggtcccacctccaacactgggtattacaattccacatgagatttgggtgggggacacagatccaaaccatatcagccatcaaggaactctgggatcggaaatcatggccaaggagccactgtggggaaggagccatgttgaggagccgtgttgaggaggagtgggcaccatccaaccttaaggaacagcgagacccaagtgtatgggggtgtcacaatgtccccagtgttggtgactgggtgatgagatggggacaagtgttccatgaataagaaaagcaaccactggggagggaagaacaggggaaggagaggggaaggtatacttggctggcaagggtgacaagagaaagggcctgctgaagctggagtcagatctatggctaggaagacacctggaggcaccgcaagactcaatcagtcaggaagacatgggctggcagcagagggaactccatgcaaggtggttcacggtggtgaaaatgagtccacccggggagaaatgagggttggaagaggagagctggggtttggattttcagcctgagcaataatgatgaacaatctgataaagaggttggctggagggaggcgagagggtctagagagtggaaccagggagatgtgtgggagaaaagtatctgaacttcgagtatttgtaaaactagtcagccctcaacctgaacgtagaagaccctaggagccgggtgcagtggctcatacctgtaatcccaacactttgggaggccaaggcaggtggatcacttgaggccaggggttcaaaaccaacctgaccaaagtgatgaaaccttgtttactaaaaatacaaaaaattaactgggcatggtggtgcacacctgtaattccagctacttgggaggctgaggcaggagaatcacttgaacctgagaggcagaggttacagtgagccgagaccacaccattgaactccagcctgggtaacagcaagaccctgtctcaaaaaaaaaggagaccctggagaaggaccctcaagaaatactcagatgttggattctcaaatgccacaaaaccggggtgaggaacgtatatcttgggaatggagaactcctgccttctaatttgtaggactgccaggcaggccaccacaggtctcattccaactaccaccagccagcttcatgaacttaactaacaagccttttctttttgatggggaggagaagtttactctgagtcttggactccttttctgcaaaatgggagtgtttggagtaggtgatcttctagcttccaaatgctatactcctgtgaatctgcgtccttggctttttcatgccaccgtctctgactgtgctcaattatagtgatgatccaactccacactctcctcactagtgcgatgaatagacactcattaggaaaaagtgaaagcccttggttgaataataatgtcattacatacttatctcaatcagggcggctgtgagcacaaacagcttcttcctgtaaattagaaaaagcccctctgctcttggcagacaaatgagcaaatgagcaaagatgcataagcaaaaggccatggcttggcaagtggagccccgctccattggggcccctctgctcccctcagcagaatgttccagagcaggcccaacctgtacaactgcacccaagaccctgatttcaaccctcaagacaatagacatggcactgatggtggctccattactcccattttacggatgaggtcgacacagagaaagcatcagtaatttcctctatatctcataggccctccacccacataccaagaccctacaggctttagattttgaaaaaaaaaatcacagttcaaaattttattgtttcatttttgcatatttatcatcaataagtgtatttccttgcctaagtagcctgacaaataatgaaggatatctcccaacctcctcccccaaacccagtcactgtgcctccctttcaattttttaggtcatatttgggcattaatcatatcacccacagtcaaaatgccatctcatctggaaggaatagagctgcaatattgggagagcatagaataaatactgagactcataattctttatcatcctctcagctcccatgtgcacttactgaaatgcatttggccaaatgagagtgggggagaggaagaaatgaatcctaatgaagttagtagtaatggcattagaaattgtattttgacttctactattattacttattataagtaatagtattataacaatatcaggagttctcaattagttttgtatcttttggacttaagaaagaaaagaatttaaatttactttttggaccaggagagcaataatcatttcatgactatattcattttcttagcctcatatgaagaaggtgaccagggactagttataacaaatgatcatgccttatttttcaaggcaccctacatgaccgaaacaatatgatttgttgagttcccatgtgagcagaatattgaacctaaaaggaagaaaaagattctgtcttcaagggatttgccctcttgataggaatgcagcgcctggacacacaaaagaattataatgagttttgcagacatttacaaattaccattgagtgctgattagcagcaacagagcatgggtctgtgtggagtttagagaggagaggaggaaagagagtgagctgaggtcagtggggatgtgtgtgctgctgggagccctggtgcactcagtagcaagcaccatgctgacctagaccaaggttctgtttctatttgagcaatgaattgaggctgagcataggccggtggtagggagggagccaggtattgccaaccaagggagtggtacgcagacctggagaacattcacagggctctggtggcagagcctgtgatgaccacaatcatcagatttttttttttcttttttgagatggagtttcactcttgttgcccaggcaggagtgcagtggcactatttcggctcactgcaacctccgtctcccaggttcaagcgattctcctgcctcatcctccctagtagctgagattacaggcgcccaccaccatgcctggataattttcatattttttagtagagacggggtttcaccatgttgactaggctggtctcgaactcctcacctcaggtgataaacccgcctcagccacccaaagtgctgggattacaggcgtgagccaccatgcctggcctcatcaggattttaagatggtgaatctatagtgcccggaatgtgatgatgattgtggtcattgttccaggtgctgtggattcactatcctgaaatccttacaacaacctttttgagcagtgacagcaaatggatatcagccagtatgccagccccatttggttggcaatggttgcttggcacatggtgtaagttgcatccagacttgaggaagggagccatggtggctactggggtcttccatgggcaaagtgtggtggtgtacatggcaaatatttgtcatctctattctaagagatttcccttgattagattatacaacctgaagtaagtgattttcataaacttatatatgattgctttattatgaagctaggagaaggtcatattagaaaaagttatctcttcctcaaggcatttttttttatttattgtaaaattgtcataatatactaagtttaacaaagccagccactctactactatcctctggaaaactgtcattaaaaaacataaagatctatagcagtgatgatgcaaataccttagatgtggcatcctgtgcaggacacagcctgcactgccatatgcagtgaccctgaaccaagtgtgaatctagtttgtctgtattagttccacgagcccacactgcctgatgaaaaagtgagtgagttgtggaggaaaggcagtacatttttataagaccttaacattttgacaaataagcttggatctgatgtaataaacaatgagcaaaaaagctgtttataagcatatgctatcctacattcagatatttatagattgaatagctataatcttttgcattttataaagaacattacagtgtttaaaaatacctcagataagttatttcatttgatccctacatggctatagtctattcctgagcagagaactgacatgggaaaaaggcggccgcaaagggagggggatctcaacataggagttctgtaaaacgttcctcttttagaaaggaaatgtgaggttgtgctcttttcctcaactaggttaggattctcttaactgaaactgaaatgtgcatttcattgtttaatttatcagcatctcaagtagacttgctaaatcatagctccattcattggatgtgccagcataattaattacactgaaacctcctgacagcatcttccagggaccaagaagaaaagacgaaacacaagaaaacagaaaaatctgggtcaatgttctacatattcatgatagtcttagtcagcttgagtcctggctttctctctaattgagtaactttgggtaagtcacttcctgtgtttcctcctctgtcaaaataaggaatagatgatctttatcactcaaggtcccaggaagaaagagatggcacattcaaattggataatttgaggtgagtctaatcagggagattctttacaaaggtgtggggagggtaagaaaaccaccagggctagtaactagcactagtatgccagggctagtaaccatcactagcccagtcctcagtggggaaggcgtgattgctagaatccaaagggagaagagttttgtagagaaggttgtcttgagaggggaagagaccttgactcgggaacataccgtgcagtgccacgggaaaggaactagagaaataaacactccaatgccaccctccacccttgctctgatctactgtggtgttcccattggccaaacacaaccagaagccagagagccagggaggcaggatgcacttcatccccttcagcctcctgcagcacgaagcaggcagggaaggagcagggagcagagctggggtaggcaggagggagctggctcacttcctaagtccaccccggctctgtgaacatacttcatgcacattaaacatcctgttctcttccagatgccaaatgttagatgtcttaggagaattattatttttttgagtagagaacatgctagcatcttgggtgaaagcatcataaagcacagtctgctatcgcaggtgagcgatatctatgttttgaatgaataaatacatgaaacaaacaaaatagtcccttctgaggtctaatagtgaggaactaagagactatgtgcagcatacacatgcatgcacacacacacacacacacacacacacacacacgagtctctaaagagctttgagcttctcacaatagcatggaatttactaggcaggaagtcagtcctgggactccaaccttgaggcaaaacccatcaaggcatccaaagggtcctattgtaatgccacctcaaaggccaggcagacctggaacccaaggattctaggcctgggaatgacttgagggagcagctagcacaactcacccctttatgttccaggctgggttacctcaaactgcagaggggctggacatgcctggcaccgcgcagaaggggcagcacctgtgtggaagccatctacagctgtcactcccccacccaccccttaagactcactgtctctcataggatcatggccctcgtgagtgtgggaaagtttgctgttttaaagatctcagagccccaaactgagtgggccttctaaagaccctcattcaccaagctctctgtagtgttagcatctgcctctcatcccagatttctcccgcagctcctgtttcatttttaaaaattctgctctccctcaccatgaacagagacccagagcagaccagtaccaggtctggaggcctcaaagcttgaagctgttctcttgatactattattatcacaaatcttaatagaaacaaaactgccatttatactgcaccttctgggtgacaggctctgagccaggaaatccaaatacctaatctcatctaagccacccatcacattggtggatctaagccacacatctaagcctcccatcacattggtggattctgcttcttattgcccataggaggacccttagacaggtcctcagacactgagcaacctgcctgagggcccacgacaagttagtggagagccagtatatctttctgcatccaccccactgtgtctcctcctctctgtcagaattagacatggaagggtgaaagagccttctccttcattgtgcttgaggccgtttcatcctgacagtcctggccttgcaaagagggcctcactgggctgcctcaccaaccaagtcctaagggcttcgcatggtacctccagggagcctgttcacctgcttccaaagtgctctctagaagacagaaaggaactaacattgacagagggcacacctatgtgcttgctgcactagacaggcctcatcacttaatcctcccacaacctcgggaagtaggaattattatccccattatacagatgaggaaactgagacctacccaaagagcaaagagtgaagtcagttttgttttgaaagccagtgttcttttcactgcatgccactccctcagagaataaaagagaaaacaggaaggctagacagagcatcctagtcaacctctcagtgatgcagggacctcctagaaacatcctaacaaggactcgttttgttatggaacagacagctcattctgttatgggacatctggagaaaacacgatacgtgactctctgatgtgtacgcctttggccttggctgagttgtggagcagagtttggggatgaggcgaaattaggacctgaaacagcggagtaattaaggcaactggagatgcccagatcacaggaatgagttacccaggtggagccatttgaaaatccaatgggctatagccatccagtcttcatcccagtgttggaaaaaaatgtgagacaggacagggcagaggacagagagacaccaatccacactccttgctattgacgctcaagtaagtgtaaatccacttaatactgttatcaactaatccacatctatcatattactcaaaaggacagcaggagagatttcatcaaaagctgaaatgagatgcatgctctccactgcattccttgacctgccaagtgccaagcctatcagaagagaaaacgagattggtttgtctgcttgattctgagtttacccacagtggcttttcaatgattcctgcattcttttctaaatactcccataccatctggttagaaatctgtttttaaatttgttcaaggatctttgccaatattaccactatgaagttgattttttgaatcaaaacagttacctacgtctaatctgcaactggcatctgcatagctggaaagccatgggttccatccctagcttagacaaacaaacccttgatgttatttacatctgctctcaaaaatcatctttaagaatccttacgaacagcaggaggaagttcctcacccatattcttggcttttttcttatcaggcagaactactggaccaaactgaagtcatcaaacttgggctaaacacctactgaccgtgtgcagaaacagctaggccctggacatatccagcactgaatagggtccagtgtgggacgatatggagtctaccctttaggccctgattccctcttcccactcctaatgactttctctcactctttttaagcaatcctcacccgagccatcaagggccttcatccttgtctctcttcttataaggtcaggcactatattttatttctcagtgcatccccagtggctagctccatgtcttccatggaaaacacactcaaatacacacttgtaacattgatgacaatgttgatgatgggttgcagcaagacacagcctaaagataaatgaatctctgattcagaaagaaaggattatggaaacacattaaatatagtgttgtcaattaatatgattacctattaaagcaggccctacaatactgtaattggtaatggtaaccatggcatattctttgagccagacccaggatgatatttttcatgattagcttttgattaatcctactagatagatatttcatttacagtctatacatttgttcttaaggatttaattgattgtgcaatttataagtattagaattgctgttatgtaaatgaattttcagccatccaattcactttaaggtaattaaattaagtgtggttagttaagaacattagacatctgtgaaaagtgcctgagaaaaatttgttttgcttagaagaagagaaggcctggtatgtttctcttctctcattttgtgcttctctccgagcctgggttctcagcactccctgcccctttagtcactgccttcttgcctctcctgctggcactaactaatttgtcagttaaagaaggacacacgttaagtgaaagtaacaacctgtttcattaacaagctcagctgcttccaagagaaaccagagggactggcgttccttgctgagacactcctctcctcaatttgttgaattgttttccaattttgtcggaataatgttgctcgtgctatgtgtattcaacatcaattttagaatcaaagctccgttgtcaggtctagtagatcagggaactgaacttacccttccctacctgctggatgaataaggagaaaagtctccttttcatacatagttgcatgggatagatggagagtagagacagcatggaattttgaggtacacaggcttgacgttcaattcaattcattcattcatgcaatcaacgcatacttactgagtacatattatgaactcggccctgttctaggcactctgagaggcactaatggatcagccacggaaacctgtctctacaggggctttgagcccacactccatatctgactaaccacatgagacattagacatgtttcttcagttctctgagcctcagtttcctgatccataaaatgggaatattaggagtaaaacttttaaaagaataaaataagataatgtttattaaggacttatagcgtagttcttaatttggggaccatggatcctcagaggaccctggaaagaattgaggggcctatgaacatggatggaaagaatgacatttttattttgattacttctcactgaaatgtagcatttcttccattgtaaatgcaggtaaaaatttactactactatagtaataggagtctgtgtgattttgtcagtaatagaaatcacatgacagctgttgcagacatcttgaaatactactgaagctcatcactacatcaaaattacagatgttattagatctgccatgagatggttatttcatgtgtttataaacaaacacatacattattgcagcataactttttaatgactatatttcagtataactggtttcctttgtagttttacatatttgaaaacattactctggggaatctatgtacttcaccagtctgccaaagaggcccgtggcatccataaaatccaagggcctgatttagatgttgtcgaacacagtggttctcaaagttgagtatgtgttggaatcctctgaggggtctgttaaaaccccctccccacacccaccatcacctcccaagtctctgactctaggctggaacgaggcctaataatttgcatttctaacaagtccccagatgatgctgatgccgctgatctagggaccacactttgagaaccagtggcctaagtatatgacaagtatttaaactcctttttccccaacattgacctggcacgtgaacactttcagattattggaatgctactaaatgatccagaacagcatattaacacaccatctgactctgctagccaggccacgctgagtgttagcccctcctccgcccaaggccaaggtcatatgaccctgctgggctgcttgcggcctcagctcttccctatctctagctccagctctgacttggcacggacaatttcagaagcactgaatattctgggatttagcatcaaggcatactcgctgcctagccagctctaatcctttgtcccttgtccccagggatgatacctagcttctgctttattccatggtacatgaatccctggcccatgccctagttcctataagtcaagagcctgtccccatgttccaggtttggagtcccggccagcatgtggtgcaacaaccatgtttctgatacctaaagattttccaccttcctgcatgtgtgagcattgcctgctattggctttcttgttgacatgcttctttcttttgcagggccactttcccttcataacacctgcataaccaggtgtctagtgccatgtccttcagacaccagatcctaggcctttccagggctcagcacctgagacagctcttcatccctagaataggcttcttcggtccaggctccagggtgtctcatcctggtggagttcactgtaaaacactgcttcatgccttaaataacacatttttcatgctttgctatttggggcagtattgaacatcagattaatataacatctttggagggccaggcacagtggttcatacctgtaatcccaatactttgggaggccaatgtgggagaatcacttgagcccaggagtttgagaccagcctgggcaacattgggagatgctggctctacagaaaaattaaaacttagttgggcaaggtggtgtgcacctgtagtcccagctactcagaagtttgaggtgggcagattgcttgagcccaggaagtcgaggctcactgtgatcacaccactgcactccagcctgggcaacagagcaagactttgtctctaaagtaatggtaataataataatgtaacatcctaggatgagcttatacttgtagtatactgaattcgattaatcatttattgagcatctattaagtactagacatcatgccaagccttagggatagaaagtcaaaaaactaagatacagaccttgttttaagaaatgcataggctaatatgagacgtaaacatataagtaagtaattgagggctcttttcatctcctctgtgtattcatttgcatagttctgctctagttagtcgttcatcactaattctgatttaagtggactatttttagatcctgacaatgatcagtttggggttctcctttggcagaatcttttagttcttttgctttcttttcagagcttgtggccccattccctcccccagtgattactggtgctgagttggctaataaagtgataaaccacttctttgctctacgaaaccaaagtaacaaacttagacaaagacaacagccttcctaggtggaggaagaccgggccgtgataacaagtgtttgactaactctattttctgctaagcctacctggtattcccacttcccatcccctcatctccctttgaacatacaccgtggttatggagttccactgggactgagtaatttgaagttctccccatactaaataagagatgaagatcatgagtacatggtgaagaaaaagaatgctacacatcatttttccattctttgatttttttcaaccaacttcagtgaaatttatgaaatatgaccatgaaagctatctggattcttaccaatattatctggtccaagtcaatcctaccactccaatgccatcagtcatgccagggaaactgcttgacataccctgaactagcgctgttctgctccagtgctgctgtaattaattagacgtttaggagagctggtgagtcaccagtgtttgagtctcagtttgggggttagggaatgaccccaccattctgctgcatacaacagtgtgatgaaacactgcttatgtaataagaagtaagcacctggtggaacatggtgacagattattaagaagtaaatagtaggaacttgtcagttgcctgaaaagcaggctgtgaaactaaaagaatgcaaataatgtaatcattcacataggcatatataaatagcacgtgctttgtccagagaactgttctggggttacctagaactgcatatgagatgaacccagctgctatgaagttaagtcagataaggcagactgaatgtaaagggatgttagtgcttttctgtgtgcacgtgcatatgtgtataactagtataaaagagtccaacagaaaaaaaaaataacaacccaagaaaataaactgagcagagaagcccaaagtaactccaatcacactgggcccctctgtctttgaatttgagctgagctccaggaacaagcacgggatagcgggcaggctttggagagagggagatgcataagctgtgagttctcgatctggtgccatctatggccttggttctgtctcggtaaaatgacaactagctcagtaaatgggtggtaaattaaatgaagtaatgtttaatacttagtaaggtgactgatacatagcaggcattgaataaatgtcttctcctcatcatctaaaaatcatgtgagctagggcaaaatggataccagtaaccctatatttctattaggaaactgagcctcaaagcagctgagttgctcaaagtcactcagttgttaagctacagagataggacttcaaccttgaatctgatgctttgggtactaccccaggtggcttctcatttcacattttgacagattaaccaactcaaaaagaatccttttttgatatcaaagttggaccacctttccacaagctctaagctagtacttggaaaaacagtctctccttattgtctagagtgaatcctatttcctcagctctgtggccacagacagctgtctgggggtatgggggttccctttcacactgttctcccacctcaggctcaatcgctgtcctctctgcagcccagctctggtaggaagcatccattcaagctcccctacatggtcatctgtttatttcagtcccttttggaccatactcccaaactggcaattcttagaaatccaattttgtctacttttttgatgactctaaaggacggaaagttagagtatcgcttgttaattaattctactttccagaagctgaaaatgcatagtcctgcttcctgaagaaaatgatcccctctaactcttctggaaacattgatataggtcagttagttggcattgtattcgccattgttacccttttaggactccactttagaaaagcttacattttttaaaattgctgtcatttaattacataggcagttgacttaagctttatttttttccattaaattaaaattaaattaagctcattattgtattagacaagcattgattgtgcccactttggttttaattaaatgctactattatttcctcctctgtagtgcttttaattttctttggtatataatttggggtaaccacaatatcagtaaattatccctcataaataatattcaaagagaaagacaaaacacactgtgaaagcaatttgaaggtatttgcttcttgtttttaatttactggtaggatatttatcagtgaatatttttccatgttgctcctttgttataaaacagggcatgcccgtatctctcttaagcagctctgacttttgcagttaatggctgacttcaagacgtcattgatcttcaaaatgtgctgactttatgtgcaacactgaagttatggtccaggggataggtgtttgaatttaagtctaagaacattatcagaaaggttcagaaaaatgcccagagaagcttacttcattttctctttaacatttatgaagcactcatttcataccaaacagtctctggggtcctggaaatgcaggaatgatagagaaccatagtctctgtccttctggtacttgtattctaaagggtaagagataatatactatatactgatcctcatccaccaagaaaacaagattctccattattaatttggcaactgtgcctaggccattattttgcaaatctagactttgagcaagatggtatattttgcactactctgctctaaatgcagcacaaggagagataacatgggaatgacataactgtcctgaacaatagacaccgtgtttccatctctcaaacccagaacagaaatggaaagtagtaagcagatcagcctgcaggccagctgagctctggggcgggaagcagtccatacagccaggaatttggcctctgtgtgataaatacttctaaggatgaccagccaagatgaaaggccagggccagaatcagtgcttgcagccagggttcacatgagatcagctcccacaaccacaaaaaggatcctaaaaaaaatgccactgaggccactgtttttcgcaagttgcagtcctaggaacaatgtcttatgactcagacccgaaccagactgcccagagattgaatctggttctgaccttgagggaggaccaaacagaggcaacataaacagccagacaggaaggggtgagcctggctggggaaggggaggacctgtaaacaaacacccatcaagcaaaaggagcctagccttcaagtacaaaattctaaaatgtaaaaccctgccaagaaagaaagccaaaaaccaatcattcgcatatgaatcctcttcagattaatagaaatttttataccagtctgaataaactttcaaatgaatacatttaagatatacttgaatagatacagggaggaaatcttttgtttaaaaagagccagaagttatgaaacagaatcaggctgaaatgaaatgagaacaggtagatatggaaaagaaccaattatacatattagaaacacaaaagatggtcactaaaataaaatcaaaatgaattaaaaataagtcttaaagtgtcagctcagcagataagatgaactctgggatggtcttgttcaaatggaaaattagaggattagaatatccattggtggttactcagaatgcagcagagagagattgtctaaatatttgaaaaagtggtttagagacatggaagataggtgcttagacatagtctaaaagggcatcagaagaggagattggaagagatggaggaggatcaatacttgggaaaataatttgagtattttctggaaccgaagaagggcagaattatttagataaaaggttcactccaactaggcagcaggattaagatacatctactcctagacaaattatagtgaaactttagattatcaaaagtaaagaaaaaaaacactaaaagctagtagaatattttttaaagggattacctataatcagaaagacatccaacctgtcattagcaacaacaacaaaaataacagaaaacagtagatcagtactttcaaagtgctgacaaaaaggagttgtcaacatagaattttgcagtcatttaaagtagtgttaaggaataacgtacaaataaagatgttttcagacttatcaggactaagagagtttaaaatttatagatctcatgaaaagactattgaaggatgtatttcttgaaggaagaaaacaaatttaaagggagggtatataaaacaaggtacaataggtagcactaaaatgaataaatttggttgctaaatttttaaacattacaattaagcattgattacaagaaatgatttagggtatctaaaaattatgaaactgaaacactagaaaaaaacaaaactggaagtggtgttcagtctatacttaaagcttgctaagttccctgacaatagaggaacactttaaactgatctgatttaataccataagtcctaaataaaatgctaggacccagatccagcagtgtgtttatatatgtgtgtgtgcttgtatatatagatatatacacacacatataaaaatgtgtgtgtgtgtgtaatgacccattaggatttgtctcaagaatgcaagaatggatcaacagaaatcatgttaagaagacaaagtcattctatcaatcaatccatctaattacctacttatataataatagtatatgatatggtttggctgtgtccccacccaaatctcatcgtgaattgtaactcccataatcccgtgggaggcatccagtgggcagtaactgaatcatgggtgtggtttttttcatgctgttctcatgatagtgaataagtatcacaagatctgatggttttgtaaagtgcagttccccctgcacatgctctctttcctgccaccatgtaagacatgcctttgctcctccttcgccttccgccgtgattgtgaggcctccccagccatgtggaactgtgaatccattaaaacctgtttttctttataaattacccagtctcgggtatgtctttattagcagtttgagaacggactaatataatatgaaaacattaataagatggagaaacaccaaagtcaggatattgactctatctatgaagaaagcaataagcataagatctaagaggaatacacagggagggttcaacttaaaatatatgtcattatgttaaacaaaacctaaatgaaaaatagtaaaaagtaatgacttgataaagccaggttgggtatgtgagtactaattaaattattctctatgcatttctgtatgttaaaaatatttcacaattaaaagtaaaacgttatttagagatgaactgtcttggggcttttcaaacttggatgtgcacatgaatcatttgagaatcctgttaaaatgtggattctctaagctgaagctagagattctgcatttctaaaaagctcccaggagataccgcctactggtgcacagactacactttgaatagcaggagtggttctcaaacttagacatacactggaattagctgggagggctttaaaaaggccctgatgcctgtgtcctatccccagagattctggttcagttgacctgaggcagtgcctagacattggtgttttttgaaagctcctcaagcaataccagtatacagacagggtttaacaccattgagataatatattttctcatttcgtacctaagagaactaagtctctgggagagggagatgcttacccaggtcatacagcttgctggggaccagaacctaatcttgtaactcctattcctgctctcttttcaagtgcaaatatttaccacagtcttttccaagttcctgccctttgggtttcctattctagaacacatgttgctcattcagtcttctcagcccaataactgcgtaggaatagcctagtagaagaaaagcaggcagatccaaggcagggctgtaaatcaaagcatgctgccattggcactctccattatctccttgcctcctatcgccccttcatgcacacactctcttggggagcttcctactgtggattttagtaatccatgtagtcgtcatggaagactaaagaactttcttatccaaagaccaggtctcagagtttctcagtttttgttgttgttgttgttgttgttgttattgttgtttttgctctcctacggcactctcctgctctgtcatcagctaaaatacaagacacttttagttcattccattgtaccaacaatactcacttctgtgctgaggacccataggatacatgccgtaaataactgaggaaaccctacctacctgacctcacctcacaccattagcttggtgcctatttaaagcatcaggtcacttttcccaggtggtgccagctgtcacacctctctgctaacctcaacctctgttcttgcatactaagccacctaatttgatacctcctccctcagatgtaggcataggcatctttccccctcagttctccttcaccttgaagaagtgggatttatgccctcactccaagtccactttcatacacagaatcctagaactagacaccagaaattcttgcaggccaaccctctattttatgaaattatggctctaaacagtaaaataactcccctgctcatggcacactgtccactggtgtatcccatcctgaccagcttgatcctacccctagcaatatctctgcaagcccagagaaagccttgatggctccaatgctactagggttttcattcccggtactggtctcaaaccaggcctttcttgagggaagaggcagaatttattcagagggatatactacaggtttgcacttttcccatttgagatctgtggtcacaaggcaagaagggacagccacaactggtttgattaggtttcctcgtaggtccactgcactgatcatattctttcttttaaggaaggcaggacatcagccaattaatcaccttctttctttgtgggaagaattgaggcttaagagcctttgaaaatcaaacagaaagtcattctgttgctgagttttaaatatcaccttgaccctctttcctgaatgtaaagtaaccactgtatcaatagtccttcctgtcacttatcacttttctgagcaggagagctgtgaaccatgcaaagagaaaaatgacagctggagagagaagtcccagaaagccatatttaaggtatacaaagaggaaaactttaaactcaaaaaccattaaaactgaaaagactttagtgatgatgtgttcaacaccagtttttagatgaaaaacttgaggcctagggaagaagctttgccaaagtcggagattctagaaacctcaatgaagacagagatgtagagtctgacagaagcacattaatcagttaaggtaggccttatctatgcaatgtgtgctgataacataatatgtataaattgagttttggtaaaatcaaattaaatgtgaagtgtattatgggagcttgtagtttccaggaatcttatgataaagactgaaaaataattgtcttcccttccacattgctcttctattttaaatctaaatttgtttacaggggagttgcttaaagccaaatatattggcaatttaatgaattcttaccgtcaagtttgttttcttactaagaggaaaatgatgaaatggtaaaatagttaaagcactgaactacaaaccaggattccaagtgctagtccagatctgccattaccagctgcatggcttgggtgaatgactgaaactcccttgctgttcgagaataatcgctcaggtctcgcgttcactaaatctgaagctggtcctcaaacacaggagcatgggcccccattacaggaatacacccacgtgatatatgagatggttcaaaggatcatgccggatctcttttccttgttagggactttgctccagtggtccctggaccagcaacctcggcattgcctgggagctcattggaaatgcagaatctttggccttgcccagacctggtgaatcagaatctgcaaggtctctaagagattcctgtgcacatttaagcattgagaagtgctggcttaaatgatggcttttttttttttttttttttttttaagatgtctgttccctgagctttctgagttcccacttttgcatctgcctgcgtgttgctggagagtgcctgtagcccccggcctgagccagccagccccacttctgctttcctccctgcgtctgactggcctctgctcttgactgctgtgtgaagtgagtgggcagattgactgacaacagcaagaagtgtcaactcatccctggggcaacggggcaataaaaagcagagacaagaaatataacagacaatcacctaggaccatacacagtttagagataaacagtcccatttaactcagcaaactctgaaaagattcacacctctccaaatgccagaagaaattataattttcattgtttttaaaataatattttactttcagttatgaaatattttagagacatagaaaataatatcacaaatattacaaacagctccatccccaccacttagaattagcagatattaatatttcaccctatttgctttgtttttctttcctttttttaaataaataaatctaaagcctcgcctcatcctccttcagcctcacgtcactctgctgaggttgctggtgttattccacatgagactgtacttttcctgtatactatgtgtccataccatagtcaatgcatattcctgtttttatcacactgtatatctcttttgcaacttgtgtttttcactccacattatgttttggggatttttctgtgctgaaatatacaaagtcacatgtatttttaaagctgctgtttagtatttagctgaaagaacaaaatgcccaggaacggttagttgaagggagtgagaagggctgtttaggaagaacaaacaactttgagttatgtgtctggtatattttaggtcaaagatttcctgtaccagatttcaagactctcatgtccttttcccagtctgaacctatcctttccacccctgagaagaatgttatcttccagatcttcctaattttgccaaggtcactgccagagcagagggcacccactcatctgggggcggtggtaggagagcaaaggaccagccatccccagacccacagccaagctgccccatgtccccctgtgtgaccctgtggtcttcaatcaaattgcctgtgactagagaaggctcaactccctgaacccagcaatacatgaagaaaatgcaaacactttattgctacaatttatcctaaaggagatttgcaaagccacatgcttgagatttatggtgtgacatccagagatttcatgcactgtatttctcatttatgggcttcaatttagttaagagaaaagaagctttctagagcaaaacaccctaaagctttggtaagataggatatttaattaattccaaaatcaccaagcgggtgaagaatgagtttcaggcctgtgtgttcaagcgtcctctgggcctgcttgttagctacctcctaggtcttggcaacagatctgtgtatgaagaaagactgaggctgtggttgaggtctcagaacctactactatctcctgctgccatcccagaaagctcaggatagggtctttccccagggcagtgtagatctgcctgcttcagggtgagccatcatttcggggacatcacaggagatgggagatgttcagggaaccctgagtgctcccaggctctagagctctctctaacacactccctttctctccaagatgatcaggctgcccagtctcacaatagcgaagacatcctttctttcataccagtctaggacccttttatgaggacacaggatgtcatggcaaggcttcattagacggcattcacttaggtctagggtcctattctttgcagggccagaaactagatttatttctgtgttcctgaagctagtcagtctctggggacatgtcttaacagtaactgaattcacaagccagctatgctcccaccctctgcacctgcccctaccattcccacaagctgggacacacttgttctccctgacctttccaaatcctgcctgcccttcaaaacccagcttaaacactgaggtcctctttgaagcctcttctcaggccacccagcctttgagtgaccgctttctttgaatatgtccatgctcatcgttgatacagatcggcatcaatcctcaatcacctggcagtgtaaactgacttgcgtatgcgtatgacttattcctcgtcagtctgtaggagccttgagagcacagcatgagctcattacttcaaagctcttctcaagttaagtacagggtaagggagtcatggaaagaaggaggagtcgtggaaagaaggccaccagggaggcaagtcctccgcctgtccaaggctctgtttccatatatgcccagtgatgggagcactcaccctacctttcctggaaggggcttgtgtggctcatggcagacaatagatgtgaaggctgttctggggctgcaaagccctttatacgaaagcaggatcattacagtcctgtgtatggtaaaacatggtttgctgattgactctaactggaacatggagtgagagttgtcctccccctagagatgagaggagggcaacatgggccatattcatatgtatgtttccattcacatgggtgtttgtattcctgttcatatgtgtgattatatcaatcctcatatttctatctgttgggtctggagccacaggcagcaaacctggggagctttgagaagctgagagtgagacagtctcttcattttttatggatggaggagcatacatcaagaaggacagtgctttgcacagctcatcaatactgaactcagactcaggaaaatagtctttttcttttttgcttaaaatcaacgtgttatctgctggcagaagtgccttccttgcttcgcctataggctcctacacagcacctccagctagaacccaagatttcggattctaaatcacattcacattcagctctgatttcctgattgccacctggtgctggccagggaagcaatttcccctaagtcttttagccatatctgaagtccccacatttcttgttgcccctgcccacacagagcctccagttccctcgcatccctctccatccctctgcctgctgtcactgtacctctgaaaccagcagccggttaggatctatcagcttgggaaccactgtgtcccaggacaagaagatctgggaccactgagaagccatctgtttagtccatgccctttaaaatctgggaccaactctgggttataaagaatcatatagcacctctgataaaacattctgaacctgagggtggggacttcctgacttgcttagctgggaaggaaagaaaatcaacatcacttgaatacatatgtgtgccaagaactccactaagcaatttcatggtttcaatctcagtaaatcctcaccacaactagagagccaagtgttgccatttattttgtaatgtggaatctcagaaagcttaagtaaatgtgtcccagaccacacagctggtatatagcaaagcccctttctctttagcatgatgctgcctctgggtagtgggatgagggggtactggccatgttagtgatgatgatgtcctttccaggctctaggacccactcagaccttccaccccaggaagtatctcttggctcctattcacgtgcccaaatcttacccagcctgcactgctcagctcaactctccctcgtggttcacttcttcctttgcacaccacagcctttctagcctgggtgtccctagtctacatctgcacctagatcctgctgctccaccccttcgcatcaactctgtgtggtctatcaggacatatgtgaatgagggtgaggcgaggtgcatggtgatctccttgaatctgctccagtgtcaaccaacgataaaagggcaaggtgatcaatacccagagagtcattagtaacaaattcctagctatacatctcacaactaatttctgcagtgtgacatcacagcaagaaatgctccaggatggaatcgaactctccacaaagcccagggctcttttacacacctaatctgtctccctggtctcttctccctgtcttccctgggcagcctcacacgctctgagtctcagcccatgcagcacacttccctgcatcctcctgtgccttgtcggggaagcacagccctccttctccaccgggaaactcccccgggtctcagggctactcactccctcttctgtgcttctaccaccgacaccctgtctcttgcaggcacggggcctgtgggtacacggagtttttttccatatacctaaacacataccatgattgtctctggagagtgggattctgtgtgttttttatttccttcttgatattttgattcattttctatatttttctataatgtatctttcctacaattatctttacaagtggaaaagaatgttggtgtttaaaatgattgtggtaattttatgtccctactgtactgtaggatcatccaggccagaaactaggccttggtttgatcttcagagcttagtgcagtgcctagaacctagaatgcgctcattgtatgtcagatgcatgaaggactagatgcatgcctgcaggcatggggaggagagggcagcatttgggttggcagctaaaggctgggtctgagccgcagcttgtgtctcctcatctgtaaagtgagcaacaaaccctggtggtcccagcatcctaagttgttctagagggagtctcctgaccactcccgcccataggcagcgctggaggagcaggctgctccctggcctgagtctctgccccactgtccctgccccatctgtccgaagcagccccacacgggaggaccaagagactttcacttcattgcagttgtgagactcgatgtcaccgttctcatttgccgcctgtctgggattttatagacatgctctctctctctgtttattgtgatggcagtttgcacaattcctcttcaggcactcagagtcttccaagcatgaagctcccagagatgaatgagcctttatcggggcctcagcgctgttcactcagtgggagccagctgtgctctaggctgtcttaaatttccagccacattttccaaacctttgactgagaggccaggaccaaagggagattggccccagggggtcgccgatctctacatagagctagcaggggcttagccactcacttcaggggaacaatgaggatggcgacagctgcctccctctagtgtggtctgggagggcctggagatgcagcctcgtccggcgggcccgagactgttcaggaatgttctccagtgtgtggacctggagattgaaggattcccttagtggagggagggattctgggaaaagatggcgggagaggcggattctgccacctacgccgtgtgaccttgggcaggagagttcacctcttggggcctatttcttccacagtcagatggtaactgtgttacctgaggggatgtggagttgggaggagacattaagtaaagggcagtcttcctcttttgctgcccccttgagctccctgaggcctgaggtcttccagcgatggtggctctggttcagcaaggaaggggtttctccaggacaggctacagggcctctgacctcgcccactgccttgcttggcctttcttctccattttccgccctctcgagttgtctgatgcttctgcaggaagtcagcggaagggctcagagactcatagggaagatgagtgagtggaggagataagaagaaggaatgcaggagcagggggtacacaggagcctggcggtttcttctgcagaaacttcaaggggttccctaactcctctcttcaaagtgaacaccagtgcctgggccctgaccagcagcaggtgtggcagccaggccccgtccagcaaaggcctcgcagtagataatttgttcaggcttttgtgcttctatcttggcttttcaacttgatctgatgaaccaccccttgctccacctctcccccacttatatcgcactagaaaatcagcctgaactaaacctccccaaatccaacagaataaaaaattaattcacgaatacgtttctgtactgcagttctgtcttgtgaaacacagcatattcctgaatccacaattttttcctagaggcaaaaaattcagatattatttctgtagagttagttacacaaggtaactggaaatctacatgtgattttaaatagagcacacaactttggcgtttggaaaaatatcaaacctcagaattaggaagtcatccttgtcaccatcagcacaaccagccgtcgttgctatttttcctttttttaagctagctttatgttatagagcatacatacactaaaaccacacgtcagtggatacatttttacaaaaggaaatcattcatggaattaccactcggaccaagatgtgaaacacttaccggcaggtaagaagccatcttatgccccctcccagtcattacagtcccttaaagatcattactatttgacttctttccctatagattagattttcctgtttttaaattttgtgtaactttatttgatagtattaactattttgtgtctgtgagatattcctgtttagttgtatgtagcagtaattcaattttgttgttgttgcagactatttcattgtataaacataccacaatatatccagtgaattaggttatccttatacttgtcttttggagcatatatacatttcttttggatgtttacttaggagggtaaaaatgtgtgtctagtcagctttagaagatattctggaacagtttgccaaagtaattgtaccaacttaactcctcccagcaatgtattgagaatgtgctccatagtctcaacaacttggtagggtccattttttgttcgtttgtttgtttttagccattctggtggataggaagtattgtttttgtttttgtttttgttttgacaaagtctcactctgtcccccaggctggagtgcaatggtgcaattttggatcactgcaacttctgcctcccagattcaagcgattctcctgcctcagcctcctgagtagctgagattacaggctaatttttgtattttttttttcagtagagatggggctttgccatgttggccaggctggtctcaaactcctgcatttccctgatgagtaatgattttgaacacctttcatatgcttattgaatatttcttttgtgaaggtcctgtgcaagtctttttacccttttttgttgtattgtttgtatttttcttaatgattttagggcttctttatatattacagacaacagtccttaagatgtatacattgtgaatattgcagatattttctccaaatctgtggcttgcctttccatttactgctttttatatcctattcaagaaatctttacttaccttgatatcataaatatattcttctatgtcatcttctagaaactttattgtttttcctttcacatttaggtctataattcatttagcattaagtagaggtataggctcatttatgttgaaaagattctcctttctccactgcattgcaatggcatctttgctgtgaatcaggtggttttaagaataggtttgttcctggacttcattcagagaagacaaacttctctgtttgtctatatttgcacaagtaccacactgttttaaatacaggagctttataatatgtcttgatatctggtactgtaagtgctccaactttgttcttcaagatcatctttgccatgctttgccttttgcatttctacgtgtattttagaatcatctcataaattgtcacacagtacaaatacacacaattctgctgagattttgattgggattaagtttaatctacagatttgaggagacctgacattctaactatagtgagtcttccagtccttaacacatgataaattttcatttatcagatcttctttaatttctccaggtaattgtttttagttttctttgtattcttgccaatatttctttaaacttactcttttgtgacttttaagtgtttttataaaagttatttttaaagattcattttttcttttgtgactagtatttaaaaatgtaatttttgttgtatacagtattgactgtgtattcaaaaaccatgttaaattcacctattgattctagttgatcattttattttttttccaaatgtgccttttatttctttttcttgccttattgtattggctaagagaactagtaaaatgtatgttagaagtggtaacagggagcctcattgtcttcttccttaattcaaagggaaagctttcaatatttcatcattaagtatgaagttagctgtaggatattcagagataccatttgtcagattgaggaagtttccttccgttccagttcctacaatggcataaaaaattttcccaaaactcagtggcaaagaacaaccatttactacactcacagattttgtggattgggaatttagacaaggtacagtaagaaaggcttgcccctgcttcacaatgactggggagctggaagacttgaagttgaggacatggaatcatttgaaagcttgtttactcacacttctggtggttgatgccaacagtagactggtggcatcactacttgggcctctcatatagtctctccatagaggctaattcaggctttctcataccatggtgagtgggttcccagggtgaccgtcctgcaagacagccaggtgccacctgtgatcttgccttgaaagtcatcaacatcggctgggtgcagtggctcacgcctgtaatcccagcactttgggaggccacggtgggtggatcacctgaggtcaggagtttgaggccagcctggccaacatggtaaaaccccatctctactaaaaacacaaaaaattacctggatgtggtggggaccacctgtaatcccagctactcaggaagctaaggcaggagaatcacttaaacccaggaggtggaggttgcagttagccaagattgtgccattccacttcagtctgggcaacaagagtgaatgaaactctgtctcaaaaaaaaaaaaaagaaaagaaagttatttagcatcattgccactgcattctactctgcaagttctgtgagagcatgtgggaacggaaatattgctgtgaccatatttggaaaatgcagtctgccacaactgctattcctagtgtgctgaggtttttcatcacgaataggtaatgaatgatatcaaatgctttttctgtatttatcaagacaactgtatactgcttattcttttttctattaatatagtgggttatatggattgagttttgagaattaaaccaaccttatatactggaataagctcaactttttgtgatgtattacctatttgatatataattcataccgatctgttaatactttgtctagaacttttgcatctatgctaataagagagattgacctgtaatttttccttcttgtagccttcttagattttgttatcaaagttatgctaactttataaaacaagacagaaaatctttgtttttctatcttctgctaagagtttgtgtgaaattggttttactgcatctttaaatatttggaagaactcattgataaagccaacttggcctggaatattctctgtagaaaagtatttaattatatatcctattaacataattaaaagtatttaattttgcatcctgttaactgtgtatcctacttaattgtgtattccattaaaatatagttatatattattttactatgctgttcatggttaccctagtgaccattagagtatatcttaaattagtatgcttgccactcctgaacaaggcaagaacctgattacttaaactccactagccaccatcctttcttttatccttttgttgtcatgtattttacagctacacatattttacatatctgaagacactattattatattaattagccaaaattcatttaaatatttccacgtattttcccttgccattgctctttattccttcttctatgactgttgcctccatttgggaaaaatttcctcttgcttcaagagcttgcgttaatatttcttttagtaagggtctgctggcaaaaaaaaaaaaaaattcagctgttttgtctgaaatgtcttatttcactttgatttttgaagaatattctcactgggtaaataattcttggctggcagtcattttctgctagcactttaaagacatcactctgttctctttcggccttccttgcctctgttgaagtcagttgtcagttttatcaatgcttgtttggaggtaatgtgtcttttcctctctggctattttaaagatttcctttctgtctttgattttcagcagctttattatgatgtgactaggcatagttttctttacatttattctatgtgggactcacagagaagtttgaagtttttgttaattttgaaaaattgtcagccagtatttcttcacatattgcctctgtcctttccctctttcctcttgtctgggacttcaaattatatgtattttagaccttttcattgtgactcacgtgtctcttgaattcttttctgtatattctgtcttttttttcttcttcctattattcaatcagggcattttctgtgagtctctcttccagtatcctaattttctgttctcttgtgtctaatctactgttaaactcatctattgaattattaattcgttattgtatttttcacttctagaatttccatttgattcttataaattcccgttttctaatgaaattctttattgctcatctgtcttcttgaacatattataattattctaaagtctatatttgataactccaatatcagacttcaaggtctgtttttatttttttccattgctttttatattggctttgggtcatttggctctgtttcctgtcctttctggtaatattttattgaattccagaagctctaaaggttgttgttcttcagagaagtttcattttcttttggcaggcagaaaccttgatccaatcaggatttgatgatttagggctgtgaagtctcaatgaatgactaaatgactgcatagaattggcagaaatccacaacttattaaaaactcgttgggaggctgggggatgatgagtgggaattttcaagaaagaagaagtcaaaccctttgtggctgggaacttcaatgtcaaggagggggatggtgccattaagagagctacagaaagggccaaagttaggaaagagtaaggagagatttcatgaccacagaggtgcagcatgcctgtgaaaagatgctgggactgaatgggatttttatctttctgagagagaacaccctgaaagatggacctaaaaataaatgcaagtgggcccttatcaaaactagtatctgaagaccacctgccactttcctgttagatattactgttgatgtcactggttctcagcaattgtcaaattaggggctctgggtattgagaaggcaatttggcacaagatagtggctggtgatcactgatttggctaattccttacattgacccaacatgtccacagatgtggaatggttctggaaactcatcttttcattatctcattgaccaggtgcctactcctccactcagactgcaaataagagcagcttcctttaggaaagcttcatagtatgatctttaccctctcagacctcattagggttgactatttccaagacatatcagccttcagcctgtgccattagcccatttatgcctagtgttccattattggaacaccaagcatgtgagtgttatttatatcctactgctcaaggtcattgccaaagtctgattgcaaaagttcaaaaaattgcaacctcaggcataaatgggttattggtaaggcagttactgtagttctttggtgtgctagttctttttttttttttttttttttttttttgaggcagggtctcactctactgcccaggctagagtgcagtggtgtgatcatagcttactgcagcctcaacctcccaggctcaagccagcctcccacctcagcctcctgagtggctgggaccacaggcacatgctgccatacccagctacattttttttcaaattttttgtagagaaagggtctcactattttggccagtctggtcctgaacccctgggctcaaacaatacaccattcttggcctcccagagtgttggattacaggcatgagccactgagctgagctggctattcattctgaaccatgaacttttcatttagaaggattgaaaagagaaatgtatgttcatgaacttattatgggctcatatcgctagcaagccaatattcttcaaatctgtatctccatggctcctcaacttcaccctaaaatatatttattaatctcccaagtgctcagcattggtctaggtcagcagttctcataatttttatctcaggactcctttacactattaaaaattattggccaggtgcattggctcacgcctgtaatcccagcactttgggaggccgaggtgggtggatcactgtgtcaggagttcaagaccagcctgaccaacatggtgaaaccccatctctactgaaaatacaaaaattagctgggtgtggtggcacgtgcctgtagtcccagctacttggaaggctgaagcaagagaatcacttgaacccggtaggcgcaggttgcagtgagctgagatcgtgccactactccagcctgggcaacagagcaagactctatctcaaaaaaaaaaaaaattattgaggaccccaaagaattttgttcatgtgagttatatatatcgattcttatcatgttggatattaaacagagaaattttaaaaatatttacctattcatttacaaataataataaatatgttacataacaatattggtgtaaataacctattttaataaacagtaaccatatttaccaaaactaaaataaatttagagagaagagttgttgtacatttttgcaaatctctctaatgtctaacttgatagaagtcaggtagcctctggaaaactctgtaatatactcatgagagagtgtgtgtagaaaagaaaaatgatattttagtattattatgagaagagctttaatcttgagggtccctgaaaagatctcagggcccccgagccacactttgagaggaactggtctagtggataggcttttataccagaaagaatgagcagattccaagctctggtcttagagcaggctcatttcttaaaatcatccttgtaccttttaaaaccagaattaatagagaatgtacttggactccatcagatggcagaaaatgataaactaagtggaaaaggaagactaattggcttatgtaactgaaaaatctaaaatagtgaaactaggcttcaggctctgagggcttgttcactgccatattcccaaggccagcaacagtgccaaaaacatagcaaatattcaatatgtatcttttaattaattaaacaataaattagtaactgttttcaggactctttatcctcaacttggcttgccatttttttttttttttctgttatcaataagactctccataagattgctcattggaagccctggtcaaacaaggctcttggtcctcatgatcccaaaacaaaagtcatcccttccttcacacagcatgtcagtatcagcccttcttggatcatgtgtccaagctgtatcaactattgtatgtgaggtgaatgggtattgccagcttagaaggggaggaggggtgaaattattaacagccttaccagaaacaactggagatgcggcagttcccaaaaaagaagaaatactgatcacacatcacacaaaattacagatgtccactaaagatatcataataacccatcaacaaatggcttatccaatcaagtgtaaacacaaattatcagatgtaaaatatgtgctctaatcacttcaatgatccagagaactgtcttgcagacaagttaccaactgagtgattgatttatgattattttattagttttagtcagcctcaaaacaaactcttcagcttttttctacctcattttcatcaaatgtaaaacttgtgagagcactgttatcatatgacacaccattgagaagccatcagcaattgcctgttacttacaagaaacagtctcaaaccctcaaggccaagccctttaattcatcacaatggttccatggttcctagcctcttaaaattgaggagccctttttaatgacttccatgaatgagaacctaattgttagtcataaatattgattgattaaaaaacataatgacattttagaatagatttccatgtgatagcacccatatgtgtttgaaaattattgtgcatatatttgtgaggcatatttgaaatgtgttctccagataaagcttggtgagtgtgagtgtgtgagagtgtgtgtgtgtctatgtgtgtgagttagtgtgtgtgtgtatgtggttcccatgactctggacatagaaacaatagatgacgggaactaagatgtcaacacagaggcttgggagattcttttctgaggtctgtactagtgttttcacggctttttaaagaagaaggaagaaatcaggccacatgatgtccagaagccctggaaccatgaagagcttcagtttactgaagtatttgtttgtgattccattttagtttacctatgttttattaactatatctttcttttttaatataattttggtgggtgttctagggtttttcatgtttatcttaaacttctgacaagctgccttcaaataatatgactatgtatagtataagatctttacattcttgtatttccaatctctacccccagcctttgtgctattattgtaatacattttaattctacatatgttataaactcataatatattgccattattttttcattaagcattcaaatcttttaaagggattaaaagtgagacaaaatgttttttaatttgcctaaatatttgccatttctgacgttcttcatttctttaggtagatccagtttttcatctgatatcatttgccttctgcctgaagaactacttttaactttttttgtttttgtttttttttgaaatgaagccttgttctgttgcccaggttggagggtagtggcacaatctcagctcactgcaacctccacctcccaggttcaagtgattttcatgcctcagcttcctgagcagctgggattacaggcacacaccactacgcccagttaattttcatatttttagtagagacagagtttcaccatgttggccaggctggtctcaaactcctgacctcaagtgatccacctgcctcagcctcccaaagtgttgggattataagcatgagccaccatgcctggcctacttttaacgttccttatagtgaaagtccctatagaattttgtctaaaaaactatttttcttcattttgaaaggatgtttatgttgaatatagaatcctaaattgacaatctttttttcttttaacactttaaagatattgctctattgtcttttgacctgtgtgacttctgacaatgagtctgctgccattcttatatttggtctctgcatatattgtatctctttttgtttaggtaccttaagattttcttcttatcactcatattaagcatttagattatgatggatcttgatgtaattttctttacgtttcttcagattggggtttgttaagcatcttggctctgtgaacttaaagttttcaacaaatttggaaatctttgtgctattatttcttcaaagagttatcctcccttctgggattccagttacacatatattcgactgacattgtcactgatattctgttaattttttccagtctttttttctgagcttcattttggatggtttctattgctttgtcttcaagtctaatgatctgttcctctacaacaaggtttctcaactttgtcactattaacacttggtgctagttaatactttgttgggggagctgtcctgtgaattataggatgcttagcaatatcctttgtctgtacccattggatgccaatagcaccttcccctcatttctgacaacaaaaatcacgtcctcacattaccaaatgttccctagtaaaaaacgggcccctgttgagaaccactgccctacactctctaatctgcttttagtcccatccggtatattttttatctcaaaaatttccatctgggcctgtttcagtctttcatttttcccctgatttgcccatgtctcctttacatgaaggcacacacaggcttctgttctaccacttgcttttataaataaatttgtgtttgaacacaataatgcccatttgccagtatattatgatggctgttttcatgactcaacaggagagttgaatagttgacgacctgcaaagcctaaaatatttgcatatttatactccagttctttatggaaaaggtttttggccccctgctttatattagtaagtatatttataaggtttataataagctgttctaagatcatcaaattctattatcgctttgacttctatctctgtttccactgagtgattatcttcttaattataggtccaattttcttcttttttgaatgcctggtaacttttggttagatactagacattgtgattttatatcatcaaggctgaattttgctaatattcccttaaagagtgttggattttgatctggcatgcagttaagtaatttgtaaatcagtttgatagtttcaaagattgctgttaagttttgctgtgtcagactcagagtagcctttattgtgggactaatttaatcctaatactgggaaagtgtaacttttctgagggctctactgaatgacccatgagtaactagatctacctactttggctggttgggacacagactgttcatagccttggatctaggaattgttcagcctgatgatttctggtactgctttccttgcccggtggtagttttccctcatgcatgcatgaattagtactcagccaaagactcaaggggacgcctttacagatttccagaacactcatattctctctctcccctacatctcccatcccaaccttgacttagtcaccaagctgtgtttggttttattctctctgcatggcaacctggaaactgcctccaggcaataatctggaaaaattataagtgtcacttcatttgtttcctttctctcaaggatcacttgtttcccttctctcaagtcttgtgctgtctgttgttcagtggctgaaacccaccattttttctagatttccagctttctatttctttgtaacatgagagcaatccctgtagcagttaatcctcatgagccaaagtagaagtttttgaggagctctgaataaaccaaagaacagactttcatattaaaacatattttcagtatgaaacataccatatctactgtgaacagcagtcatcattttctgtggtatttcaagtgaatggaatgtctggaatccttcttcttgctgcaacagtcaatccaaaacaagggagcacgtaagcactaatttccttgggtatttcacatgttaagagaagtgggcatctaaaccatcctgtaaaaatccatctaaggtctaaaagaaggaaataaaattatccttcattacatgtttttggtttattattgttagcatgttagtcttaggtcggatttatggtgtaggtttttacgattatatgttataagactactttgattatacaatcagcccaaatgtgctgtaatatgttctatatatttattcccattttataggatttggatcatcattttattatttcagatgatgttacattttgctcttgtgccttgttattggctatatttataattaattggatcctaagtctttggttaacagcataaccctttttatgacataattcctatggggaaaataggaatcattttataatgatttgctttataacactgttttcaaggacacattgtagcaaaaaggagccattgctttaaaaggactctagtttaactcttgcatttcttctcagtatggtacaggcatacctcattaagatattccagaccaccacgataaagcaagtatctcagtaaagcaagtaacacaaattgtttggtttttccagtgcatatgagttttgtttactaagtgtgcaatagcattatgtctaaaaaatgtacataccttaatatgaaaatgttttattgctaaaatatgctaacaatcatttgagccttcggtgagtcagaatctcttagctcgtggcaggtctgacctcaatgttggtggctgttgactaatcagggtagtggatgctgaagggtgggatggctgtggcaattttaaaaatgacagcaatgaagttcgctgcatcaactaactcttccttttatgaaagagttttctgtagcatgtgttgttgtttgatagcgttttacccacagtagaacttctttcaaatttagagttaatcctctcaaaccctgctactgctttatcagctaagtttatgaaatattttaaatcctttttgtcatttcaacaatgttaacaatatcttcaccaagaatagattcgatttcaagatactactttctttgttcttccacaaaaagcaactcctcttccattcaaattttatcatgagattgcagcaattcagacacatctttggagtctccttctaattctacttctctggctgtttctaccacacctgcagttgctttctccaatgaagtcttaaacccctcaaagtcatccgtgagggatggaatcaacttcttctaaactcttgtccatgttgatatttcgacctctgctacaaatcaaaaatattcttaatgacacctagaatggtccttttttttttccagaagagtttccatttgctttgcccagatccatcagaggaatcactatctatggcacttacagcctaacgaatgcatttattaaataataagactgaaagttgaaattacttcgtgatcaatgggctgcaaaatggatgttgtgttagcaggaatgaatacaatattgacttccttatacagctccatcagagcccttgtgtaaccaggtacattgtcaacaagcatatttttaaaggaatctttttctctgagcaataggtctgaacagtggacttaaaatatttagtaaaccatgtattgtgatccagacttcgttgttacatttatagggcacaggcagagtagatttagcataattcttaagggccccacaattttcagaatggtaaatgaatattgtttgtaacttacaagtcaccagctgcatttgcccttaacaaaagagtcagactgtccttttaagttttgaagccaggtattgacttctctagctatgaaagtcctagatggcatctttcaatagaaggaagttttaatctatattgaaaatctgttgtgtagtgtagccactttcatcagtgatcttacctagatctctagataacttgctgcagcttctccatcagcacttgctgcttcactttgtacttttatgttatggacatggcttgttgccttaaacctcataaaccaacctctgctagcttcaaacttttcttctgcagcttcctcgcctctctcagccttcctggaactgaagagagttagagccttgttcttggttaggctttggctgaagagaatattttggctgatttgatctcctattcagaacaccgaaacttttctgcacagcagcaataagtctgtttcacttttcttatcatttgtgtgctcccttgagtaacactttttattaaaagtcctccaagaacttttcctttgcattcacaacttggctatttggtgcaagaggcctagcttttggtctgtctcagctttcaacatgccttccttaccaagcttaatcatttccaacttttgatttaaagttaaagacatatgacgcttcctttcacttgaacacttagaggccattgtagggctagtaattggcctcatttaaatatgatgtgtctcaaggaatagaaaggcctgaagatagggagaaaaatggagaatggcatgtcggtggagcagtcagacaacatttattgattaaattcactgttttattttggcgtggtttttggcatcccaaaccaattacaatactaacatcaaagatcactgatcccagatcactggaacagatataataataatgaaaaaatttgaaatattgtaagaagtatcaaaatgtgacacagagacaagtgagcacacactgctggaaaatatggtgccaatagacttactctatgcagggctgccacaaatcttcagtttgtaaaaaatgtaatgtctgtgaagtgcaataaaacaaggcgtgcctgcatgtgtatatgacttatgtcctccgctgggtaacaaatgtgcttagaacaatgatcaagtattgcattctttgtatctacaatgccttacatttaagaagaaagcagcatggcataatgctattgtatttcaaacgattttttcatgcatcaaaactctttctttaaattgtattttacatggaagcccaatttagaaaatatattaacaagaattcttctggctgaagtgagatcaggagctcagcccccacatcttgctgtgttcgttccactcctactgcaaggtagtcactaaaacctcttcactgtggagcaaggctccagggtggatgggtcaagatttgcaatgagtcaagctgagttccagctgaggatccactgtgtacttgcttagagatttggagtgagtcacataacctttctgaggctgctttttacaaaacatggattttaatcattataatacttctatatcagtcaggaatgcttttagctgaaagtaacataaaattcagtttatggtgatctaaacagagattcgcttttcttacttaaaaataagttcagaggtatgcagttactaaatgttttttagacattcagtgatattgttggggacctcagctgtttttatctttctgtcccatcatacttagcattttggcttttatttgtatgcttgttacttcagtgtcacaagatggctattcatttataagttccaggaagaaagaagaagcaaagtcctctacctctggaagttgtttgtttttaattcaggaagaaaaattctccctcagcacacttaaaaaaaaaaaatcattagctagaacatgcccatccttagccaatcagttgccaaaaataacgagtttgcaacaatcaaagatttccgcctgaggattagatagggacttatgttcccaagttttaaggaatctccagcccaacctctgaaaacatcagcgtcctgctgacagaagagagggagcagcagaggagtgtccattggtgtccgccatgtctgtccctattcctgcctgaagtttagatggctgccatgtgcttcaaatgtggatgttggagaaagtgactttcaacctataaaagcaccaatgaaatgagatcattcattatgttaacctctcggtaaattaaggagtgaacaaaggggaaaatttcaatggagaataagaatgaccttgaatgtcctaagtcagcagttatcaaagtctgcaagtttcagtgtgctgcaagaagctgtttgtttttaaggcatatgttagatggcatcagaaggattgttaatttaaaatataaattcagtcctactgaaggtggacctctaggtgagtcccaggaacttatattttgaaacatttcccaagtgacctataagcctattaaaatggaaaagtgtggtcctgtatgactgggaaccactcagtgaggcaaaagcaggtgttcttgggtagatgtgcacctacaatgggcatttgggagtatcagaaaggggaacaccaaacaaaagggcaggttgctgactggtagctgtaccttctgtttagcacagcccctccacagtgtaagcactcaatcatggcagcaacttttattcttactgacaattttctccagcaccaggagaattcaatcttaatggaggcttcagctatggttcagttgttcagtcactgtctgtgaaatgaagccactatcacccaggtctgcttgtgatagacatcattgaaactcctaatttgatccacagggaacaataggaaattcccaatgcattctgtaggtcaataagaaatgttaagcctcaagattgtgttgaaggcatttgcaagattgatgcagtatctataaagggcatggagtccctcaaatgaaagacagcccaatcaaggtgtaatgattagcgacatctccttagcccagagcattggaaagtgcagatgataaattactataaacgcttaatggaatgcttcaaagttctatgtaatattacaacatagcgtctctgaagctaagtccccgggtgtgactgagcagatgttttcctggttgattttgaagcaaattaatcaagttatggatgattattccaggctgtgtgtcccaagttacataactgtacctgaaatgattgtcaaatgtaaacaaatgtatacccaagcatatacgtttaagtttacatagctatgtgtgtgtacatgtatgtgtgcatgtatgtatatgtatacacattgtaaaacactgtgggagtcacatgttaaacacgattataggtttaaaaagtagattacatgtctccatttgtcattcttagagtctttttttcctataagctaagcacaccggtaagctttcacaaaggctattggtgagagtagcatctgagaccttcctgacttcctaaagtattgatgatagtactttcaagatgctgaaagactgtggctggacaggagaaaagtatgtgtgaaggatttttttgttttagtaccttgtacaaggcacctaacctctctaaacatcagtttcctcatccatgagaaggaaatcataataccgacatcaaaggattattgtgggaagtgaatgaaataatgtatgtaaaacacccagtacagtctgacaaatagtagactcttgataaaccactgttattggttttatttatctctatatgtagatgtgacaggtttgaaaacgtgatctgaacccaagctccctgattcatagtgttgtttgaaggcaccatctgagaaggagcaatgtaagaagacaaagagtcacgcccagacctagacaagtgtacaatagggttcagggcctcacctgggctcctgcaggaagagttcccctgagacctgcagatggaaacctgtccatacacagaggccatagatgcactgcaaatgatctggaagaagccttagagaagtactgtttggaattatcccctgaaagcccatttcccagcagcagctgaagccctccctactcctaaccgaggctcatcccttccggtttacttcttcaccttatttctgaagttcacctgagcatagatgggcagatgcagtgactcaccacccagaaacaccattcagccaggtgggtaagattccagctcctacatttcaatcgagccaatgctgaagtgttagctggcctagtggactaagtaggtaaggaaggatactcccttcacttttcagacccagagaggtacatctccccttctgttttaaactcaagagaaagttaccacggtgcctttctgctttcagtgtgctgcaagaagctgtttgtttttaaggcatacaatggagaaagcagggtctccagactggcttgtgattactttctttcttctttgagtgtggtcatcttgcagtagaaatgtcgttctattttgtctttatgtgcgtggccacttttcagttattctcccctaactgagaaggcaagggcacactctgtataaattgtatattctctgtaaagaaagaaaccagtacacgttgagcaactattaggagatggagcattattctagatatttcacatgtgacatctaatttaatcctcaaaaataaccccacaatctaggtggtaatattcccattttttattatggtaaaatacatataacataaaatttaccatttaaccattttaagggtacagttcagggacattaagtatattcatattattgtgcaatcattactgccatccaactccagaatgtttttcatcttgaaaactgtaattctgtaccagttgagcaataagtcctcattctccctctagcccctggcaaccagcattctactttctatctctatgaatttgactactctacatacctcatgtaagtggtatcatacaatatttgtctttttgtgactggcttatttcacttctcatgtcttaaaggtttatccatctcggagtgtgtgtcaaattttttttcctctttaaggctgaataatattacattgtgtgtgtgcgtgccacattttgtgtaatcattcatctgtcaatggacacaggttgtttctactttttggctactttggctgccatgaacgtgggtgtacaaatatctatttgactccctgctttcaattctctccagtatatgcccaggagtagaattgctggagcatacgacaattctatgtttaactttttgaggaaccaccaaactgttttccacagcccctgcaccattttacattcccagcagcaatgcacgagggttccaatttctcctccaccttacccactcactactctcattattttctggacattgttgttgttgtttattgataataggcatcctaatggatataaagtggtattcccaccaggctcagttttaatctagagctctttggcctcaaacttatggctgtgttccttgcacccccacaatgctaggagtgcagggacctcgggaaaaccacagagtagagagtctgtgtaagagaagagcctggttgtgtcagttctctttttcaagagccacccaaagatggaaaggcagtctctgcaacataattgcccagtcaagggcacagcccagaacttcagtctgtgcagttataaatagaagcttttgaattcccatttctcttacttctcttagtcagtcaagtggtttttgaccttttctttcttgcatccggaggaaggttccccctggggatattgtgcttgttcccttctgcagccaattagatcattttgattgtggagctaacaaaacagtccttatttgaaaactgacagtgaaagagagaaaaagagacagaaatagaagcagtgaaaagaagacggagggaaaaaagagaggattgtgaggttgatgtaattagcatggcacagcgtttcagccagttaaacaacatccatttctgtcccccgcacacaggacagcagaagtctccaagctgatcagaccacaggccccaccttgctgctctcccagggtaggagagggttttcatgtcttcgtcatctgacagatgacacagctaaggctcagaaaaggcaaatgccttcattgattccactgaaataatatgagacaaaggcaggactccagtctgctgacagtccctctgggctctcttcacactgttcccgccacctcctgctgccacaccttgtgaaagagaccaggaccaggaccctttcctcttaaagtctcgtctctctcttctgcaaatgtctattatgaaatagacatgaaagatggggcgaagaagtgaagagctggattagatgacgtctaggacccttttcaagagctcggaatgagagagagctagatttgagtttctggcttcatggccctattgtgtaaattagggccagtgattttcttctctgagcccgcttcctcatctgtgaagcaggtacatgaaactaaccgcataggacttttatttgaacaactaagggagtatagaactttaattttaatagtatataactttaatagtatataattttaactatatgtatcaattgccaattatgtgcccagtatataggcacttatgtactaggtgatgggtttataggaactctctgtactatttttgcaacttttatttaaatataaaactatctcaaaattaaggtttttggttttttgttttggtttgtgcctattatataggcatatgattagcaattgatatatagaattaaaataatattcatcaatgcaatttcattctttctactggaaagacaccccaaattttgagcccttcttgtctccttagatttggaagacagcacagcatatacaatcagatcttcgtgtctgtgggttctgcatttgtggattcaaccaactgaggatcaaaactactaggaaaaaaataaaaagtaacaatacaacatagaaaataatacaaattaaaatatagcatcacagctgtttacctagcacttacattgtattaggtattgtaagtaatctggagatgatttaaagtatatggaaagatatgtgtaggttatatgcaaatattatactacttcatataaaagacttgagcattcttgaattttggtatccacaggggggtcctggaaccaatcccccagaaatactgagggatgtgtatgattttctatatcccacagttgaaaataaattcaattctataggtcatccaagaatgggccctattttactgaattagtcttgctccaatttctagcagtctgtagagactcacatatgcaagccctcaggacccaggccttagactgtgacagttccatccggtagccaaagttattaacctgcccaccaaaagctggagaactcttttgggggagcactgcgtgtgttaatccaactattgcatttaatccaagttattaactacttgaattaaattgaactcaatcaaacatctagaatgtgagatctccatgcttttgtgtgtccctggggtatgctggatgctgtgagtgagccttttctctgaggtccttaacaggcctgttctgtttcacatcttcttcaagggatacctcaaattttcccaaaactgtgcagtccttctcctcacacttgctccatatcgtcttcccttcctctttttctttctcttttcctttatcagctcctcttttctcctattccatctttccttcttcattctcagtcttcctgtcattcacaaataaatatttaatatctactatgtagcaggtactgttctagcacaaggcagataagcccttgccctcaagaaacttgtatttttttcaaaaaaaagaaactttttattttaggccaggtccggtggctcatgcctaaaattccagcactttaggagaccaaggcaggaggactgcttgagtttaggagttcaagaccagcctgagcaacatagtgagaactcgtctctaccaaaaaattaaaaaaaaaaattgccaggcatgttggtgcacacttgtagtcccagctactcaaaaggtgaggtgggaggatggcttgagcctgggagattgaggctgcagtgagctatgctcatgccattgcactctaccctgggcaacagactgagactctgtctcagaaaaaaagaattgttttgagatagtttgatatttaaataagagttgcaaaaacagtacagagtttctataaacccatcacctaacttcaccttatgccaacatcttatctaactaaaacataattactgaaaacagaaaatcaacattgatacaattctcttagctatcctacagatcttattagattgttgccagttttcctactcatttttccagttcaggagccaatcccgtttcctgcattgcatttaattatcgtatctgcttattttcctcccatgtatgacagttcttcaatctgaatgcatctttcatgaccttgacacttctgaatagaatcgccaggtatttggtacaacgtcactcaatttgcatgtgtctaaccttttcttctgagtagactgaggttctacattatggagaggagaccccagaagtgatggatccttctcagtgcatcatatcaagtgggcatctcatgtcaaaatgtcttgtaactggtgatgttagtcgtcggttacacttgaagttaacgtgtggagaggtggcaactgatggttttctcttctgtactaaagtttctgttttctccattataattaattagtatcttatggggagatactttgagactatataaatatcctgtttctcatcatgctttcctccattgattttattatgcattgtttttgagcacttccttactcaagaagcttaccttttattaggagttagacaatgaagaagtaacgaaataaatgagatgactttaatgaaagcgttataaagaaagtgtaagagggtgaagtgagagcaaagaggtctactttagagggcacatcaaggaagtcctctctaaagacgggacatttaagctgagtcctgaatgaagaaaaaaaaaaaaaaaaaaacaaaaaaaacttgagtgagatctaagagaaacacactctaggcaaagcatacaacagcaaaagccttgaagccagaacaagccaggcctgttggagaaaaggaaatcagccaggcatggctggagtgcagggagtaaggggccaagtgtagaagacaaggaggaggaagtaggaagaaccaaatcaagtgacgtctgtaagtggggtagagagtggggacgttttcgaagcacagtgcaacctccttcgttaaatatattctcaactgtgctgtccaatagggtagtcactagccatgtcagctacttatatttaaattgttattgattgaaatcaaataaacattttaaagttcggttcctcagtcacagtagccacactttgagggtccactagtcactctgaggctagcggctgccctattcgacaacacagctatagaacaaattcatcatggcaataacgtccactggacagcgtggctgcgtgtgttttctggaggtcatttattatgttagtttctaggggatacgcaaagttgaatgagttatggcccttattctccaggaacttcaagtttaggagacaaatatgcaaataaacatagtaccagacagctcatattaagaatcacgggcatggcacagaaaaattgctgtcggatttggatgcggcactgacaggagatcaaaagaggcttcctggagaagcaggggttaaatgtctaggtaagattcttttgggttgagaggaggaagttatgtccaatggaagtttgatatgagctgaggttttcgaagacagcaagtacaagatgaggatagcaagtagtgtaggttggctgcagtttggttgtgtgtgtgtaggagaatgtgaaagggagattttagcaggaaggagggcgatagagtgtgaagggccttggagccaagctaaagagttttatctttatcccagaggcagtgggggagctgtggatggctcttaccaaaggagtaacattattgaagttgtgcttaagaaagattggtcagtgtgcagcatatgaagtggatgatggctggggagatggactgcagagaaagggtgggaaatctatttgcagtagagcaggtgtgaggtcattcctcttccagcatctatttttctgaaacctgaaagcattctcaagcacaagaagacaggctgcttgaaatataacattcagaaataaacctgagattagaaaacacaccacttactctttatagcaagcaaacatcagacccacaggatgtaattaagctcgttgaaaaacaggcactctttgtgtgtgtttatttacacaaatcagggttttgtaaactttagggctcataaaagtcacctcgagcagcttattaaaatgtggagtcctgagccccgcccccacggactctcacttcatatgtcagggatggggcctaggaatctgttttttaacaggaatgcactatgattagggtagtcagtgatctgaggaaaggcgcctgagaaacaatgcccaacctcttttccttttcagctttctaacctcaagctaacaggttcctcttctcattatttataggccatagtcctgcaaacatgaaaattgttcctctctcattatgcctttttctctcacctccatgaatcagtagacttaagagaactgtaacatattttttccatttataattttttattttatccacttaaaataggcttaaagaattacccttcattttttctttttccccaagtgctgatttccagagcttaatctatctaccctctgtctatgtatcccttatattggcgtttgtttttctttgccctgtctgccccacacaaccaaaaactctgagggcaaagaccttgttgcagtcacttctctgaaccctacagggctcagccctgtgccctggaattgtcctagttagccctggtacaattagagggctggcccaattgggaccgcaaatgttctaaaaaccctctgaattggcatcattaccaaagccacttgacagacaagatgagcaagtctcagagtgtttatgtggaatcctcagaagcatacatgaacatctgagcggttttgaacctcggtctcagaacctggcgtcccatgtgtttctattgttcgctgcatgggctcagagaaggtaggtaaaggtaggtgaaggaaggtttggtgatactgatgttctttccctgcggtcacaggagccctactgtcaaggagggagcaggaaggggacagcattttcccctttgccctttgtgttttgcttgctattatccacttccaactttgacactttgtcttcctattcctccaatgccatgtgcccacacatgatcagcacaaacaagcagccattccattagcccatcttcaagacctatgttcccaattcacaggtaactggggagtccagacagtgataattgcagacctttcctccaatttcacacaagtaaagagcttttacaatttaacacagcccctttctccaattatgtcacatttcagacaaaatgcttgagcctcaacatttcctttggcaatccatgcctctacagaacagatgggggttctgagataagagcctcctctgcacagacagttcctgtagggaggcgatgggggacagaacaaacatccgtaagccctcagcttctacagacagacccttgggggccctggcccctcccaggggctttcctgttccaagttgcatgcccaggtgaagtaagatggatctgaactgtgaatggaaatgcaccaaactgttgtgactgtcagagcccacattaatggaggccccaacacagcagctgggcagacaccaacatgcaagtctcctagtgatgaatttgccaagcagtttgaagaaaagttaggaaatatgcagccctcaatgtccaagatcaacgccaccaccttgggaagccttctctgcttccactcacttacccacccactaggcaatgaacgtgctttcctgtagacccccagaggacattgtttaggctttcactcaccatagaaaattcagattagttgacttgtgtccggtaccatactatattgtgagagcacattccatatcttatccatcttatatccctagtctctggtttctggcacttagtagctgcttaatatatgttcacctaatgaatgaacaaataaataaatcatatgatatggcatggcaagacagctacctgcagctattggaagattgtcatgcaaagaaagattgtttatggcctttgtgcaatactggatgaaatgagaatcaagcagtggatgtcatgattttaataatgtaaagtagaggggttttgtttttgttttagcagcccagtcactgagaggttgagatgagtcagctgccttgggggaagcagcgagatccccttcatggacagggtttaaaccagaaactgaaggagaataaataaagattttctaagaggattcaggtgcagacatttggaggggtgaccggtctggacacttttaaggtttcttccaaccttgagactctgtactttcaggatttgtttttattcacctgcatggctgctttattggtctgaatatatatggggatatttttcatcttccaaagtaatctgaaggcagcctctccgtttacccatggagcttttggtgggaacggtggattgacttatagtggggctgactcgtatgttgcatgattcactgtgctctatagatgtccccaaacacatatatcagtgtctgctgttccaggatgacactgttatttcccaacctgtgcaaatgcagctgtaaaaaatgttgcatggccaggcttcccttccccagagtgtagagagagagcacacaccctctggtttaacacgcccatgaggcacacacccccttttctgaatttcaacactcaggttcaagtctattaagaagagaagagaattgcaaatgaactcacattactggccaaacgaagccagcctccctcctaaattactgcgtatattaagtctgtgggctgcagaaactcctgcaccatctgtggctccctggaaaatcaaaaaggtttccagcagtttcagcacacaagcaggctctgagacttctctctttgttagagatttgattcgaactgtgtccgttagcagtgaaatacaaaaggaaaaaaagtcagtatggtatagctttgaaatattttagcaagcgccacaggaaagaataatagaccataaattgctgcatctggccttaaatttatgaagaaaacaataatgcaaaaaaccaagaatgttactgtcctttgtcatttaaaaagatagttttgactccttatcagtttttgttcaccctttcactacaccaattgtgaaactgcaacaaaggcaacatccctttctccccaccccacccccattaagcaataaattttgccgaaaaactcacacatatttgagcagcaaagagattgggaaaagttgagagtagtaaggaccccaccccatcccaaagacaagatgtgtgcgtgggtttctggttaggaaacaaagccaggagctacctggagggcctgtgccattgaacctgaggtgtgaagcggccatctgagctcaaagtgaaacccctccacctctcccccagccactctctttctatgaaaggtgctattgaatcatgtcatctcctaatagaagctgactgtggagagaaggatggggcctgactccatgttcttatcttttatgcgtgctcagaagtccaggaccaattttattctattttgcacattggggcaatcatcttggactgagttataataaacacgagattttttttttccctcctaaagccactccttgctgtgctgctcaaaataatttccccatctgacaaaagcaccacatgccagtaggcctgttctgcgtggactctctgtccgcgtcttacccagatactgtgatggtttagtctcaactctccctgcccaggtgctgctgtacctgccagagagatttctgcaagaaatcatgatgggcagtgctaatgaataatggagacgggtaggggaggagactctggctggaaggtcagctgggggtagattgtggagggtcttgagtgcctccatcaggtatctggacttaattcaaaatggcatccacctccacccacgtgtttgccaggagacgaggccccagctgcgtttacagctgactctggtggccacattgccaaggaggtccttaggggagggttggttccttactcctcttccagtgagtaagtgcctggcaccatcagttttaagtgattaatgaatgaaacactctgcttaaatgatatcaaataccctgatgaagactggaaaagaatattaagcacacagctcataaaccacacactaaactctagcttccccagcatctgcattttataaaacagctggaagggtaactaaagtttaaactcttcttcctgattcttgtgaagatacagacagcctttggccaccagatttttctaagccaacacagggacactatttgcacactatttttcatgaaatgtggtcatttacatacatttgcatagtgctttcaaaaagccttaattccaagtatgtcaaataaaataaaacaaattagtgtaatctactgccattgtatagcagctcagcttggagatcttggcagtggtggcggaagagccaagaatcagtttttaagaagctccgacaacccagatttagtgtatccaggggtcaatagacacagtaaagtctgagaacagggaactctttgggggcagggtcaagtttcaagtgtctggatagtgctagtagttgacaaatcccagttatatctcttatttaagtctcacaaaaacctgtgtacttggtagggctaggattgttaagaacttttctacaaggggatcggaggggtcaagtggattgcctagttatagcctggtaaatagtcctgccaacatgcaaacctaagacaattccaaatccaggcctcatggacctcagagccttgttgctctgagaattgatccagagttgccttgagaagaggtaaaatgtccctatttgctggttgttgtgttttcttcattttttttgttgtttgttttgttttattttgtttgtttttttgagacagcgcttcacttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccagcgcttcactcttgttgcccacgctggagtgcaatggtgcagtgtctgctcactgccacttccacctccccgtttcaagtgattctactgcctcagcctcccaagtaactgggactacaggcatctgccaccacacccggctaattttttgtatttttagtagagacagagtttcaccatgttgttcaggctggtctcaaactcctgatctcaggtcctcaggtgatccacccccctcggcctcccgaagtgctgggattataagcatgagccaccatgcccagcccttatttactattaatccagcatctcctcttcagacaccacactgccactgggaagcgatgtgagggaaccccctattggctctggaagagcgttacccagcctgtgatgcatctggccctaagtaattgtctttttatagtttgagacagttatttgaaagttatggtaatggggtgaaaatataagcagcttatagtttactagaacattaatcctctggggatgatttcttttcttctccgtgcatctccatgggacctttttcattgcattgtgtgaaatttatttttagacttttctccctgtgatctatcactggcccacctctgcctaattattaatttccatatttgctaagctatatagaaagggttcaagtgcaggtcaggccagattttggaccaaggacccaggaccttttcagcagaggctcaggggagacacacaatgggaagtaggagtcaaatccaaatgggctttggaagcagtcagagctgagttcaaatcctggctcctttatctttgataacttggccttggcctctctgatattgagtgtcttcagtcacgcacctgtaacccctagatgcccaaactgatgctctaagactaatcctgtaaatttgggtaagcctgtatgtggacaggcatgggcaggaccaaggagtcagctactataaccagcagccctaggatgcagaggagacttccagggccgacttattcatgagaaagaggaatgcacagtgcctagggccacagtacttttaggagcccaaggaaactttttaatttcttgaaaaatcagaagaaaaaaatgaacttttgagtttaataaaatggtttaaatatatgacattaatatactttgtatgcattaatatatgctattaatatatttatctcaattactgatgcaattgtaaaacagaatttttaattttttttgtataaaggatcccataatggcaaaagcacccagggcccccaaaagtcataacgcagccctgggagttcttgcccagtcctctgttgtctcctgggcacccactcctcctttgttcaatcctcatctgttcatttgcaaaagagcttccaaatcaggcagccttgggctgacctagctcccaacatttcatgatgcccagtgagcacccacggggcaggtcctttacatcagtgtgacctttggtttgcccagacttggccacctgcctgccctgcatcttgcaccagccagtatcattccacattcttcagtttccttcatgttcctgcccataaccctcaaccacctcaagccaagcaataaaagagaagaggggagagttcataaatggagctcccgattcactctctgtcctacccccaaaagcctccccacgtaggactgttctggcagactaaataaacattccaatggcaatcacgttgctctctactgtagtttattttatgtgaacatttgagaaaacagtagaaccaatgccaattcatatgactttctgtgactcagtttctccttttgcaaattgggcgtaacaagagcaatctggtagaaacagtaggaaaagaaataaaattacaacctggagaacgcagaatgcccttcagaagaaacatcctaggtacgtttgaagttattattagcatgactatcagtgagctcaagcctctcagagtgcctggggcataaggacttcctgtatttataaggctacacgtcagcctcctcttccttcctgattcaccatcaattgctttcaccactactaaatgggccctgagctccagttattctcagtttatgcccacaacctgtgaaagggtgagtgagccagtggtgggttaatttcaggagactagcccctttccaaccatcctgagggcctcagtcagtctcccaggaggcctgcaccctaaggggtgagaaattgggagcaagaagcaaagccagcgggcaaaggagggcagaggctgtaaggagaaaaacccagaattgtattaaacaaacaaacccttcccccaaactggaagggagccaaaagaccaaagaaagactcggtggcaagtagatgagtttatttggccttacatacggggcactcctgggcggcagcagaacagctctaaagatccagcccgcctcccatctctaagctgcttttaagctaattttctggctctttgcctactgtatgtatgcaatggaactgttttcctcattggttctcagatactctctgggaggtttgcattctcagggacacctgctccctggcaggcaccatggccttggctcacagcctggtcttcagggttcaggcagcaggcatagacccttaagtaacctgtgacactacagaggcaaacaaggagaaagaggagaagtgcaagaagcgaaagtttagttaaaaatgccacagggatgggaaaggacgccctcaaatgtctagtgtcacccaaggctgatgccttcattctctgttccacagtcatcctttgagcaggacacacaggacgtgctcccagaccccctgcaacttcatcacactgtagccaccatgtggcaattaaccttacccagtggtagagtcacgctttgtccctttcaggtttcaagttagaatcagagatcttcgacctggaagggacattgagaatcatttgtctaacactatgtttttacaaattaaaaaattgaaacccagaaacttaaggggcttgtccaagttctcacaacaaagaaatcaggactaaaatcccagatctcctagtgcccagtcgaaagttcatttcactgttaagcataaggtttttaggtgcgtacccttcccacatgcttaggatctaggtgtgcttttactctcattattttatgcatcctgacaccaaccaggcctggaaaacgtgtactacatccccatttttaccagtgaaaaagcagaggctcagaaaggctaagggagagtacccaagactcaagggagaatattgaagatcgccaggtcattgtggcagagctggaatcaaacccagtctcacttaccaatactctcagacagtgcacttccctccatcccacactgcctcaaagcctactgtccagagctctgtggttatggatattgtgaaggagcaaggattcccatccatgtttataggcaaacttctggcccaaccgcattcatgctcagaagtctcaacatttttttttttttaatttatcagaggaaagaaagtaacaatagagttgatgggcaatttgtgtaattaacaccccaaatctcctagtaccataaggtttttggattcagtgcattctcccaacagatgctctttttaccggtcaagtgtcattatcacgaggattataatggagtggaagagaatggctgccggagaccagagggtaggcaggatatgggtttgtcattagtggtcttgggtgcacttcggtgcacctatgagcctgcttcctgtgaagattttaatgatgaaaccagcgagctctagagaaggatttggacatctgcttctcaattagtgttaatttagcttgtttggaaatgatttgtgcctctacaagacaacataactgaaagttgttttctttcctatgatcataactttttactcttctcacaatgggccagatgaatgcagcagaggggcattcctgggctgcagaggaacattcctgggctgcagaggaacagtggatagtcctgttcctgccaatttggaaagacattgttgctccttagtctcaatgcaactgtaatgcccaaatcaaagtcttgagaaatgtccagccccttccaaagcacttcttggaagcaggtaattggcccttttatggttgttaccccagggcagatgttaaggtggtatacacagctacaatcatgctggttattaaaacattgacatatttccagatcaattgaaaaatagccatttctccaagccctacaagtgctccatcacctcttcagcttccccagactcagggatcccagatgagcactgatcaagagcttccctggtacccaggcacccacaacctgccagtcaggccttcatggcccctgcatgcctgccccattcctacatgtcccccagccagggcgggccctgccctgctaagggagacaccatcccttacagtgacaccgagccctagcaggctaatgcccactctgtgattcccccagaggcacctaaagtgattgattgccaaatggttttaatggcactctgcctttgagttcctttgtgaggtacacagggagacccctgctctatgctcttcacaggggcccaagcagatgtgctgtattcttgttggctctgaagttgacatagacagatctagagtaggttctgcccctgagcagggcgtgccagcactacctcttacagtgttcaggtgagcaatgctggagcctgatggccagacccggcctgcagggacaaactgggttgagtgtgatgggaagtccaagtccaagttggctattgaagccggagacttggccagccagagcctggaggcacacaggagtcaggaaaggcaagagggagcgagaaatggacaaaatctgatgttcttgcccctcaaatcagagtccatacacaaggatctgtgagttctctatgataatttaaatgatctcatattgatgataatctaaaagaaagtcatttttgcctctacctttgcgcttgtgttctggatcactttggcatcaaagagtggtgctttaatagttatcagacttaaagacagaagcaaggtagacttgtcaagggttcatgcccttgaaggtcaaatgattgcaggggaccctgacaagagaagggtttgcagcagttgcataccaaaaactcttagaagaattgattcatcagccaggcactgtggcttatgcctgtaatcccagcactttgggaggccaaggcaggcggatcacctgaggttgggtgtttgagaccagcctggccaacatggtgaaaccctgtctctactaaaaatacaaaaattagctgggtgtggtggcagatgcctgtaatcccagctactcaggaggctgaggcaggagaattgcttgaacccaggaggcagagattatagtgagcggagatcgcaccactgcactccagctacttggcaacagagactccgtctcaaaaaaaaaaaaaaaaaattgattcatcacgtaacctacgtaacatgggcatatcaatcatctgaaaagatgtgtattagtggttttttttgtttttgtttttgagatggagtcttgatctgtcacccaggctggagtgcaatggcacgatctcggctcactgcaacctccacctcccaggttcaagtgattctcctgcctcagcctcccgaatagctgggattacagacactcaccagtacgtccggctaatttttttttttctttagtagagacggggtttcaccatgttggccaggctggtctcgaactcctgatctcaggtgatcctcctgccttggcctcccaaagtgctgggattacaggcgtgagccaccatgcccggccaaagatgtgtattagttttccatgattgctagaatggatggcttattcactcaaagttctggaggctagacattcaaaatcaaggtgtcagccaggccatgttctctctgagactctgggtagaatccttaccacttcctagcttctggtggtggccgtcagtctttggcattccttgcagccacatccctcccacttctgcttctggcctgacatggccttctctctgcacgtatctcccatccttttttttttttttttttttaacaagaacaccagtcccgttggatcagggcccaccctaatgacctcaccttaatttgattacatctgcagagaccctatatgtggtcacattcacaggtgccaggagttaggatttcaacacatctttttggaggacataatataatccattatagaacctgagtaggagccgtctattctctatctgtctgtcctgtgagcagcgatattgtttcagcaaatagcaccttccatcgcattgaattgatgtgttaatttaaacagtatggttttatacatttatatttattttttattaattattgaattatttttgtttggttttaatagtcaagtaagagctataagcataaggagtttatacccacgtttgtgctttacattttaaaataatatgagaatacataatttgtcagctcaggcagtccttgacaattgtcacctgttctatttaaagcagctacatgttgtttcagtactagaaaccctggagtccagatgaattccagatgtgagaagagactgtgccttttctaagcttgataggtggtcagatttcaagttcctaaggacctgtgtactctcaggacttgcagatgtcctcgaggtaaatgttgaattttgaaatgacctggagccaacaccagttctctcagcaacaatatctgggctacagaggagtcagattctggcttggagtcccacaggcagggctggtctggagatagccaagctccagaaagatgggtggcccctggagccctagggaagaactggcatctataatagaacaagcccacagtgctctcctccccaaatcagtaggagcgctgggggatattgtaacctactccattgaccctcatggccctgaggacaggtttgctctcagcaccccagcaagacagccagaatgtcagtctaaggtatttgcttcatgttctttgatcagaaatggatggcagacactagtggaacttcttagctccacctacatattcctgaaggcagccctctgaaggtcaggtgggatctgggagagtagccttcaaccattggcagcaaattactgcaaatttctttgctttctatttgaacatttctttgagttttgtttgaattttaaaatgtttgaatctcatgctttaaaaaaatattaaacttgtcttctcaaaataatttgattaaaattgatgcttctgaaagatattccaggtttttcctatgtcatggtgcctgctaccagtcttattcccttctcacctgcaatctccaattagtgcagcactaaataacaaatagctatgggacatttttcttctatgaccagctcatgtgaacaaaacactgtatatggaacaagatgacctggttcaaactctaatacttataagatgtttgaactttgaacttacatctaactacactgagcctcagtttcctaatctggaaaatgagtattaatatgataatacctgcaggtcttcctcattggtggtgttatgaagattgaataaaataatgtcagtctaaggtatttgcttcgtgttctttgatcagaaatggatggcagacactagtggaacttcttagctccgcctacatattcctaaaggcagccctctgaaggtcaggtggaatctgggagaatagccttcaaccatttgcagcaaattcctaatctggaaaatgagtattaatataataatacctgcaggtcttcctcattggtggtgttatgaagattgaataaaataatgggtataaaagcttttcaaaatataaatgactgtttgaatctgagttagttttgccgcttgtctatgcccttcagccagagaccaccaaagataatctatagttaaacaagtttggttgattactaattgtagcatgaagaataaacatgtagagtgtctcagtaagagggtgttagaaagaacctattatggaatttgggctttgttgggtaatttgaggtggggcttagggaagcaggactttgctctgaattggatggtgtcattaggtagcagcaattctataattgtttatctcaataaacctccattgagaagaaagactagaatgaggataaagctgtatttggtaaagaagcaggagtaactcattttggtcaagagaagatgtttggcattttggaggtaacacagtgatcttatctttgtctgtacttagaagtggcctcgctttgtctcattttatcaagatctcagacaagccttgtctgaacttggtattctgcattctgtgtctaatgggagaatcacatggcctacctgtgagtcaggccagcttctgaatgtcagaagctgctcttttatttctcacattacgtatgttcaaaccaacagattctctggagaaacatgggcccacgtgggggttcaaaaatagatgtactcagcatatctaagagacagaagaaagaagggagggagaaaaatgaggaaggaaggagaaacataaagggggaaagaagttgggaggctgtagagtgttcacatgtcctccaagactccccaagagctctggaagaactaaaatggatcgagtgatttccgcttctaagaggccaccattagaaggcagcatcacatggttggccgagaaaacaccaacaccatttgattcccttaaagggcaccacttgaatcaaatcctgggactggttgtagatttgacctcttttggcacccctcactacctctgtcactcctgctgagttccatgtcatacagatcttcgggcctgtgctccctaagtggtttgaggggaaggattccagagccattttctcctctggctggtctgtgatcacagtgcacagatgttccataaaactttaaaatgactaagccatttatctctggtggctaatcaagcaggtttaaagaattccgaggtatcaaggaaccacaagtgcagagtggaaattgaattgtggtcacagatacgattgggccattaaaagccaaacttgatgggctaagagagagttatcagctgatgagcgaacatcaatatgatagcaaaaaaactggcctctgttgaaaggggcttttctcaaaggcctcatgatacccagtagaagatgaactcttgatacctgctgtctctctgttaatagcttcagttgaatcagattaatttaaaggggctaatgaaaatgatgtaggagaagagtttggaggtaataatttgatgcaaaggtattggcttaaagatgatgacgttataaaaccagtcccctggggaataggcagagagaactgggaagtgattaggaagcagggggttcccgctctcaagggttcttgcctcccctctgccagtgcaccgtgcctttctcagacaggagcatgtggcaatatcagctgacatttatcagtaagaattttatcagtaaggttcctggggaattgaagtatttgaatacatggcacacggtaggctcaatatctattttatttaatgaatgaatgccaagtagtagagactctttgtttcctttattggttagctcatttccactgtgttttgggtaaagacccaaatcttaaaatgatactggaatgatacttaaattccagtatcatttgcttgatactggaatttctaaggagttccagtcttcccaatggttttataatatttgtatcttgcctttttctttcatttccaggaaaagttctccagatgtgcttacagtgccttctttgcttcttcctatcattttttcgaccaaagttatactcaaaccaaatcttagcattatgaaagccatgtcttatacagaaaaataaaaatccttaagacaaaggtggaaaattacgtagttaacaagtgggaggtaaggtgaccaaatggactccactgttacttctttaagggtcagagttacccaggtctgtctagctggctgctcttgtcacagttcctcagtcatattggcataagggagaagcttgtgttgcttttggtgttaaacatacctgtattcaaatcttagctctagctttttttttttttaaaccaccgtgaccttgaattgacttcataaaattttcccaaacttctgtatttttatgttttcaggaaaaagattgggagagggggtaatatttgactgtgttgctgccaaaactagatgagaacgtggatatgaaagcacctggcattgcacctgcatgttcaaactttttttttaatcttacgaagtgctcagttttatcctcttgttggtggcatctggcagggctgcctctgacagaggcatataggcattactcttgaggtagactcagcagagaacaacctggatggtgctgaagactcctaggagactgttgagagatgagttttgaagttccagtaggagggttcatggttcctggggaatttaattatttaaatacttgccacatagtaggctcaatgtctgttttgtttaatgaatgaatgacaagtagtagagactctttgcttccttcgtttggttagctcatttccaccgcgttttgggtaaagacccaaaaatacactggtaggaggggtaatggactgctaaactgagaggtcccaagggctttgcttgatatgggtcagctgcattcatgaacagccctgacctaacaaccaggagatctgagtgctttaaataattgtgtaaccttgggcaaatcagttcaattctctgaatttcagtttccttatctatgaaatgacagctttgagctagaagatttctattattccttccagttctaatgatctgtgatccaaaattgactgttctcttgcaaatggattccccatggacctaatggaaaaaggcacaatggcctcatcattcaaccctgagctcagcaatgtccattagaattgaaaggcgagcctccattgaaagtggttattatacatgttgggggctgatcaatgcctttcctttgttggtgaagtgttattttgataaaaacttatcttatgaattttaatcatgtagattgtcagtactcctcaaactctaaagaccaaaccattgttattacttattgactgacttacagccaggtcaaagaaacaagtcccaaacactggcagctgaaatatttatgatgcaactagtgttgcttccaagtaatgtacactgtattcaaaaaggaacacattatggcaagccagggcttaaattgatgaacgtgtttccattttagccatgcaaattatgcatcagagaacaatcaatatgaatttgatattcccaggagacaaagcaggcgtgggagtgggccccgggactaattctactttctcatctttcagaaaaggaatgaactatcctcaacatactaccctagcctccgtctcatttgcattaggtcattatgctcttccatccaaaggacaatatgcccacttggagtgtatcatatagatatataagattgagattaggagttagtttcttaaaatattcagttaaaaattttatgcattccctttccaaccaaggataataccgtaaatattctggtacaggtgcaagtggtgaaatgatatggaaagcatcctgtataaaactccaggcacaagcaagcatccccttctccatgctttgccttttcagtactttacaaagcacattgactggttccaactcttgagagattggtgcaaaaaaactctgagttttaaaatatcttgtagatattccattaagccgggcctaagagatccagaaagtcttaattgcagacaggatggatgtgatatttcttttgttcatttatttgttcattcattaaacagtatccattaattgcctttttatgccaggaaataagttcctattatagtctgggtatacccatacccatagattccattttccttccagaattgacttattagctgtacctcatcatttcatttttttttttttaagttgacaaactatgactcccaggccagccacctggttttgtaaattttattggaacacagccatgcttacctgttacatattttcatgctgcaatggcaaagtctagcaggggatgctatttgggctatattgccctcagtgattaaagaggaaagagatacattttcttccagcctttagcaaaagagcaaagtttatcaatcagtgagcaaacacttattaggcacttcagcaaggcctcgaggtaagcacttggggggaacaatttggtattctctcagatatagtatcaagcctcctaatggcctcatgtttcctcctcaaaaccctctagaaacttgccacctaaagtgtggtcaacatccgtcttgtctgggagcttgttagaaatacagactctccagccccaccctacactaatgaatcagaatctgcattttaacaaaattctcctgtccacttctatgcatgctaaagtttgagaagcactgctgcagaccaaaagggcctgagaaacaatcacttggctgatcaaagagtattcacagggggcatcctgaagtccctactatgggttcaatagtgtcataacagcccctagttattgttaaactttgcctggtcactttggaaataaatagggattatctctaagggtcctataaagaggacttttttgttaattgtgtgaaatcatagatggtacagctgggaaggatcttattgactatctatttcctgctcatacagataaggaaacccagagcagggaaatgatcaatagctcatagctagtaagtatgagagctggagttagaactaaggtttctgaatgtattatctagtgcttactcacccccacttcactgagcagtgaagacagggggtgaagcacatgtttagacaaatgtttagatgaatcactccagatcaattgatgcgcaatggatccatcggtttaaaaaaaaaaaaaaaaaggaaaaggctacatctagtttaccattgggttatccattgcttagggtcaagttgtcaaggggagaaaatggaattataggaacatggccagtttgtaccacaattagtgccatagcatgagtcagggacaatgtggagactgaccaagtttaatcattaaataaatgacctcgttatcatacaaatctgaggttgattgtccatttgcattgctataagtgatacctaagacggtaatttataaagaaaagggctttatttggctcaagggtctgcaggctgtacgaacatggaaccagcatctgttcggcttctgatgaggcctcaggaagcttacagtcatagcagaaggggcgggggagcctgcgtatcacatggcaagggagagagcaatgggaagatggtgccaggctcttttaaataaccagatctcatgggaactaataaagtgagaactcaattgttatcacaaggacagcacaaaaccattcatgagggatccaccctcatgacccaaacaccttccactacgaccacctccaacattggaggccacatttcaacatggcatttggaggggacaaaacatccaaagtatattcttttctgatatccaagaaatagttatcagagagaggcctacctgtaacctaggcttcaggggttgaggtggtagcagggcaggggcattctcctcaaagtttcttctgtgctaggatacactccctcaagccctatccttcaagggtcagctgaaatactgggatgggatgggatgggatgggacgggactggacgggacgggacgggacaggatattctctcctctactgtcctgggagctcctaaagatagagtacacatctgacttgtatctgggtccccaaagtgcctattacctagtaggccctcaatcctatttgttttgtggaaccttttgggagaagctttcatagttcacagattgattcagcttccatcacaatgactgcaggagctttgtggaaccccatatctgccagcaccatcaccatgacctagttatcatacaaatctgaggttatagacagacctacatgaacacttacacagtccctgttgcagttcttgcttgcagtggcaatggtatacatatttcatatcctgacctctgctgagtcaagggacaagcaggcggtttgcatagaagcctgggcaaaaagaaaggtttgacctccttgatttgtcagtctccatgtgcctagaataagtcattataaatggaaaaaaataaatcacttcagggatttttatttgggacttaattttagctaaaattcgaatcagttggctacaggagtcaagaggattgattcccatctcctccttaacccattagcctgaatgttctgtcttgcacactgtggtcctctgtcttgtagacacagccttaaatacacattaacattaatgactcttgggagatacaacctgagagcacgttatcttcccatatttatcatttggttagattttcaaacctcctaggtccctttgtgtcttatatcagaaatcatttgattgaatcacctaaatcaattttcctttactttcaggtagcttactgttgtcctttgtagctcttagcttatactgattctcttgtgtctggcatctccaggtctgtctttggtggaagtgattatgtttctaagaactcttactcttatccctgagatacagaagaaaaaaaaaaaaaaagcctcgccttgccttctagtgcagcctctttgtcctcaccttgcatttcagcccagctgcagtcaatctggaatgctgacatactgtaccaggcttgctcttgctcggctgtttgccttctgaagttcccgatcaaggtgtccaaaaacacagggtgttaggaaatttgttcaaatcaaagtgagtacataggaaagcatacacagtatttggcctctgcctgccccattcatttctttgttcattcattaaacagtattcattaattgctctctttataccaggcaataagtacctatcacagtctgggtatgcccatagattccattttatctccagaattgacttactagctgtatgtcattgttctgttttttaagagttgctctagggcatgagtgggcaaactgactctcaggccagccacctggttttataaataaaattttgttggaacacagccatgcttatctgttacgtattttctatggttgtttttatgctaccatggcaaagctgagtagttgtgttaaagactgtatggccctcaagcctaaaacattgactatgtggccttttacagaaaaagtttccctatcattggtttacagcatcctttgtatatttttagttggttgtctttttattattgagttataagaattctttatgtattctagatacaagtctcatcagatatatgacttgcaaatattttctccccatctgtgaattatcttttcagtttcctgatggtatgctttgaagcaacaaggtttaaaattttgataaattctaatttttctatttttttattgctgcttatgcttttttgtgttatatctaagaatccattgccaaatttgaggtcataaagattcactcctatatttccttctaagagttttatagttttagcctttatattgaagtctttgacaactttaagttttatatcttatatgaggtaggggttcaacttcattttgcattggatatgccatttccctgaaaaatttttttatagactattctttcccccatggaattgtcttggtaccctctcaagactcaaccacaaatttgagggtttatttcaattctatttcatggatctgtgtgtctatcattatgccagcataacattgttgtagatgcaattacactgcagtaagttttgaaatcagaaaatctcctacttggttcttcttattaaaaactcttttggctatttggggtccctcgaaaattttatatgaattttaggatcagtttgtcaatttataccaaaaagttacctgggattctgatagggattatatttaatctattgatctatttagggattatcatcatcctaacaatattaagtcttctgctccatgtctgggatgttttttcatttatttaaatcttatttgatttccttcaacaatgttttgtagtttttcagagtgtaagttttgtacttcttttgtaaaatttatttccattttattctttatgctactattctaaaaagaatttgtaatatcatttttgaattgtacattgccactttatagaaatataattgatttttggtatactgcaaccttgctgaacttattagttctaatattttttagtgatttcttagaattttctatacacaaggttatgtcatttgcaaatagagatagttatccttctttcttttcagtctggttgctttttatttatttatatttttgcctaatttccctggctagaatctccagtataatgttcaatagaagtggcatgagctgatattcttgtcttattcctgatcttaaaggaaagcattcagtctttaataattaaagtataaagttagctgtgggattttttgtagatgccctttattagcttaggaacatttcttactattacttgcttgttgactgttctgtcatgatacggtgttcaagtttgttgaatcttctttctgcgtctgttgagatgatgctgtggttttgttttctactctactgatgtggtttattacatccattgatttttgcatattaagtcaatcttgtaataaagcctaattggtcatggagtacaagtctttttatacgttgcttgattgagtttgctagtattttgttgaggatatgtgtgtttatatctataagagacatattgatctgtagatttcttttcctgtaataactttgtctggttctggtatcaaaataatactgacatcgtagaatgcgttgggaagtgtttcctcttcttctattgtttgaaagagtttgtaataattggtattattttttaaatgacataattcagtagtgaagatatctgggcctaagattttctttgtaggtaatttctttaattactaatttaatctttttatttgttatgtattgattcagattttctatttcttcttgagtcagtttcagtagtttgtgtctatctaggaatgtatctatttcatctaagtcatctactttattggcacatagctttttttaaacagtattcctttataatcctttttatttttgtaagtttgatagtaatgtcccctcttccatttctgatattaatgattcaagtattttctcttttattcttggtcaccctaggtgaagatttatgagttttgttgatttttgcaaagaacaaatttaagttttattgattttctctattttttctattctctgttttattaatttctgctctttgttatttacagtctctgcatgttttagtttgctcttatttttctggtatcttaaggtgggtggtgaggttattcacttgacaactatcttcttttttaacgtagacatttacagctataaatttctctttaagcactgttttagctgcttaccatatgttttggtatgttgcatctttgttttcatttatctcaaagtatgctctaagttttcttatgatttctcctttgacccactggttatttagaagagtgttgtttaattttcacttatttgtgaatttcccaaatacctttctgcattgatttctaattttattctattatggtcagagaaaataatttgtatgattttaattcttttaaatgtattgagccttgttttgtgacctagcgtatggtctatcccagagaaagtttcctgtgcatttaagaagattttttattcatacctgctgtagaaagcatatagacagattttgggtttctgtttcccccattctgacaatctctacctttttattggattgtttagtccatttgcgtttaatgttattattgacatgcatggatttttatctgccattttatctcatttttttctatatgtctcatgtcttttgttctttttatctcatactgttttctttttttattaagtgaatatcttctagagtaacattttaatttgtttaatgatttttttctcgacattctattgagtttttttcttagtagtttctctagggcttaccatatacatcttaacttattagaattgattttagatttatattaacttaattccagtgagatacagaaacattgctctcatatagctctattcccctccactttttaatgctattattctcatacatattacaactatacatgttataaactttaccacaaatacattgttataattgctactttatataattttatgtcctttaagcttgcaggaaaaaagaagagcaagtatatatttatagtggtagtgatactaaccttcgtatttaccatttctcttaaatttttttgtatgttaaaattactatcaggtgtgctttccttactcaagtatgccttttctgccccccccaatcctttgtgcggttattatcaaatatataatacatttctatttattttaggcccagcaatacaattatatacctattttttatgtaacagctttttttttttttttttttttttttttgagacggagtcttgctcttttgccaggctggagtgcagtggcgtgatcttggctcactgaaacctctgcctccctgggtttaagcgattctcctgcctcagccttctgagtagctgggactacaggcgcaccccactatgctcagttaagttttgtatttttagtagagatagggttttaccatgttggccagtatggtctcgatctcttgaatttgtgatctacccacctcggcctcccaaagtgctgggattacaggcgtgagccaccgtgcccggcctataactgctttttaaatccattaagagaaagaaggacaagaactatgtattaaaaaagtcttttataattacatagttacctttcttgatgttctttggtgtgtgtgtgggtagggggtgtctaattattgtctggtgttactttcagcctgaagaaattcctttagtgtgtcctgtcagtaacaaatctcagtttttgctgatctgggaattttttatattgacagagtttttctttcagcactttgaacatgccaccccactgccttctggcctccattgtttctgatgagaaggcagctattaatctttttgaggttgctttgtaagtgataagtcatttttctcttgctgctttcaagattttctctttgtctttcagcttttttaccatgagtctgtgtgtggatgtatgggttgaattttgtctcccaaaaagacatgttgaattcctgaccccctcctacctgtaaatgtggccttatttggctttagtgtagtctatttccctgcagtgggaagcctttcatgtcattctccagagggcatggtgtgtgtgatcatcctaggatgacactgcttttaacaagtttctctttgactgtttatttccctgatctctgttaaaccaactgcttctgctggcatcacatccagctgtaggcacttactaattgtcagctgattattccattgtttttggcaaagctctggggtaaatgttgcgccacagtctgatccaattaaatgtgagtccctttacagacataatttttgaggccactctttgaaggttttttctcactccagcaggttcttcttagctatctatttccatggttctctctggagaaatagctaaccaactgtttagcttgttgtagatagtcatgaaactgccagtctcctctcagttgtttgccacaaaaatcataattgtttgtaagagcattcttaggcttgaactccctcacaatctgatataaataaattctgttgctttggggagaactttgaagatctctattcttatggccttcttctctccctgggcaaaatctctgagccacaggtctgaggcagggagcaagagattgtggcccacttttcttagagtgacaccctacattatggtcagagtgctgagcagggtaagtagcctctcttcttctcaacatgtctcttgcagcttagaacatccatcctacacatgagctgtggtgagggcaactggagccccagcattatcagcatgacatgcctgaggtagagactccactctatgagggagaactggatagagtaagggatccccaacttcttggccatgcttacctggagtttagcctctgccttgtgtagctggggaaaattagaaatgctcatagcctgtccctcctgggtaccaggaggtaccagacactagatagggaattaggggccgggggaaagcctctcttggctaaaccttcctggaatggaatttccattatattgagccgggaggggaaaagagagagcaggtcatggtcccaatgttacaaattctcactgtccttaatgagttttagtagcttctcttaattttttttcatttgctatattcccttgggacaatttccaaagactttaagtgattgtgtttctaaaaaataatttttaccagttatgcttgtttcactggagagcagatctgcagggctcctcattcccccattcaaaagtagaatccctctgcaattctttatttttctctctctgataccagacagtgaatgcctttagaatagggtctgtattcaaataataatttctgcctacatttactctctgcctggaggtctgtgaattttatttatggtaccctcaatggaaagttaattattatcaccattccactggtgagaaaaccaaggcttacgaggttaagtgatttgcctaaaatcttaccattagtaaatgttggttccaagaacacaaaccaagtgtctttctctcaactccatggtcttcccactccatcaggctgccgttgtgtctctagcacctagcatagtgcttaggacacaggttctggctaaatgaatgaactatcattgaatatacaaataattaagctcttagggaccagaagcttaagaatataagcatactgctactctcactccttttgcattttgctttcaggctgattgatgtacctccatggcaaccttcttgactttgctaattagttcttttgccttaatggtaatcataatatacaagaacaactttaatcctaaattcattaaattagatcagtggctattatgtagccacgatattcagaaaatgtagtgctaaggtctctggaatttgcaaaaagtcttccctttgagtttattttagtgccagattatagtagtattcttttgtgctacttgatttttgcataatttgtcagtttggctatttttaggttggtcatctttgatattgtattgttaagaaagtcaggttagataagccattcatatcatgattgtacctgagtctgtttttgacacatacattgatctattggacaccccaaaagtttggaatcaataacttcattccaaaactgagctttatcttttaagttccactttacctttctctctttctctttcttgcttagaattaccttttcattacccatgtaacgtgaatttattctccttgtgaacatttctgtgaatacatatttatgtgcgatacatgaaaaaaaggcctgaaaagatatattccaaacttttacaatggctacctctagggatagaaagggaaaggggaaggagggagtctgctggtcaaagaaaatgctaggcttatctgtattgttttaatattttataaggagagcatagcctcctcctttctgtgttccctctgttcatttgtcattcttagtgcaaacatatgagaatgtgtttatgtgcccatgtatataaggtaaatgcagccaaaacctcctcctaggagggtcccccagtgtcctaaggagttattcaccccttcttaatttttctgtcttaagtaggagaaaaggggtatcattattcttgcctgtgcctttttcctctgcaatgtacatttttctattagcttgtgctgctgcagtttatggcagttttattgctccgattatttgcccagtaaacaccagcttggtcacgaagaagcagagaaaattgaagaggtacttctaaagacacatcctgttaccaatagcaagttgcctccttgattagtgattcaagctaaggccacctgtggcgtgatctaagccttcgctccccagtggacactgtctgctgcaatgagattagtcactgaagggcccacattgttggccaggtcaatgcaatgtggtggaaaacgcaagggctttggggtttcaatcttggtacaaattctagttttatctcttaccagtcaaagggctcacaggcaagttccagtttctttcaagtctcaggttcctcctcctcccccttgtttctcctcctcttcctcatttttcttttagaattaaatgaaatgacatatggaagatatgaaagaacttagttccgttatagctaaggcacacaagaggtgttttatgattgactgccacttttctttctttctgctaagagagaaaaaaataattctttctccttcttctggcaggaatatgccctctatttctctttcttaaaactatggagagcagtccttacccacgctcatctcccctggcattgttgatgacatttccaggtaagatctcttaggctgaacaaataattgatgctgggaaaaaaaaaaaaaaaacatatcaagtgttattaggattgaggcttgaagttttcatagactcaggcactgttcctcaagcagttcctgaaaaagcttttaagatgaaagatttctaatatctgtaggaagagtaaaacctggaccccttaaggaacaataaccctaggccatgccaaatgcttcctttctttagatgaggactctcatgaagaaatagcagctggcaagagatgtcaccggcatttcttatttccatatgataagcttgatgtaaaggtgcctaactagtttcaaaaagaaaaaaaactaaacaaaaattcttaagcatttcttcagaaagtgttagagaagacagaaaatagagagtcagactagcacctcaggaagcacccaatgtactaaggccaaggcactcctcattgttggtattaggttggtgcaaaagtaattgtggcttttgccattattttgcaccaacctaataaaagaagcctggactagagaggctcccccataggatcagggatgaggtttcatctgagtgagtagaaccccaccaattaggtacatgtagtcagtcattcacaagcctctttccctggccaaggagactgtgttttctattagtaagaaagtcaggagacccaagaaaccctcctggaactcacttgattttgctgggaactgttaggttcttccaaaaatgactttgatatcattaaagttctttgaagacttttaattctgtaattctgacttagaaaggtggagtcacacctaccttacctacaagctccaaaaagactacctggctttggtcttcagactctgattcctttgcctcccctcgtggaaaaagctcagggagcctcactggagaggctttatcaaaatggagttgtctgggtgaattccagaatggaaacaacctaactgctacttccaagcactcttggaggttaagaaaaagagaggttagctgtaaaatgaattgcttttctagaatttctagcaaacaaaagttcttcctcaagatattacagtggggtgttctgtagagtttccgatttgcagaatggggctctggaggaaggtttaaattcaagggttcttctttatccccactgcggctgcgatctgggcagaggtacacaggatgcctgaccagtggctggcacttaggagtctcatgcctgaagcagacactctggtctctctgagatacaggacgcagacaggctgaacgtgagacagtgagctgggagtcacatctctaatctggtgtttatctggtgggagtagggagtcagaggtcaatcacagaattgctgttgcagactgttagagtggaaagaggccttagaaatattgtccgtgcctgtgcttttaaaggaaacaggctcagagagatcaaatggctttccaaatgcctcctctactagcacgtccctcaggagtctcattcctctcaatgttctcagctgtcagcatgcttcctgacacgtgataggtgctcaacaaatgtggaatgaatgagtacacattgtgctgctgactcaataacggagctgaaatgagtaccaagactctcttttctaccccgatctctcaagtcaacactcagtattactttctctgcacagtcaagcattggcacttggagctaaactaaggctcaccaaaggcggcctcctgcctgcactcaatctggacagatttgccactcactgctatgttggccttgtggattgaaggatctgcagcttccagtaccagcagaggatgtccgttgtcttagagaacagattggagccaatctcccctttggaagctaggacttacagaaccaacgacactgtttcgccacagctgccctgggatgaacgtggaatgatggcatggagacagagaggtcaagagccaccagtagctcctggccattgcttttcctgacaagttctgtgatggggagaacatgcgacctccccgagcatgtaatcacaaagtggagagggcaagctatgtcgagcaaaagtaaggtctggctagcattctctttctccagactttttaaataacaggctgcagggctagcatttctcctccgtgtggttattatctgtttctttttgcaaagcaagacattccatgaagggtgctgggactgcaaagcgggtcgtaaagggtgacaaagcagaaagagagttgcctgcagtctcctctgcatacgatccactctgcctgcttattcatccgcacagaggagtcgcgggccccactcttaaatggcttcattcatgatgattgacttcggagatatgcccatgccgtttgcagaatgttaagcaggaaaggatttttccctcctttgaaccagctgtgttaggaggctccagtttcacaaactcagggtgggggaggctggaaggaaaaatcagtcctcaaccagaatgcgttcctcaaatgtgaataaccgctgaataaagatggtaatgaactttgaagaggctcctcagcatgaaactgatgcctcaaggtgctcaggtattctccgaccaattctaagtagcatttaaaaccttcaaatatctgtaaaagtttgttctatttcagatagcttcacttctgtctactgactagctttagtccctacataacaggagttggagaagatctgaacctaattgttcattaaaaatcaaaagttggatttgtatgatgcattggagcttgcagttgtggtccctaccttttttttttttttttttttttaagacagggtctcactttgtcacccaggctggagtgcagtggcaccatcccaactcacagcagcctcaacctcccaaattcaagcgatcctcctgcctcagcctcctgagtagctgggactacaggtgggccatcttgcccagctaatttttgtattttcagtataggcagggttttgccatgttgcccaggctggtctcaaactccttagctcaagtgatttgcctaccttggcctcccaaagcgctaggtttgcaggcatgggccacctcacccagccagtccctgcatttctagagaaactgtcagcatgcattttggttcaaactttctcctctcaaagtttgattcctgcagtagcttcccaaggtgtctccattcttcacagtcctctcacccctaaatattctaatgccaaaatatttttcctatggactattttgtttatataactttcccgatgataaaccttataagcttctcattcattcccttatgaaaaccaaacttcttcatagagcagttaaggtccttacaaatgaccattctcattttgtatcatactcatcctctacccctgatctccattccagccaggcaggttcataccacatttttagccaatcttcaggcctccccaattctgtaacctttctatatgcttgttcctccacccagaaggacctcacctcccatctctgtttaacacattccaagtcatgctgcaaggtcatgaaggctttactggtaactcttgtttgggaactccttgtattataagcacatggggaaatgaccatcttggccagttgcggtggctcatgcctgtaatcccagcgctttgggaagccgaggtgggtggtcacttgaggtcaggagttcgagaccagactggccaacatggtgaaaccctgtctctactaaaaatacaaaaattagccgggcatggtggcatgtacctgtaatcccagctactcgggaggctgagtcaggagaatcacttgaacacgggaggcggaggttgcagtaagctgagtttgcactactgcacccaagcctgggcaacagagtgagacactgtctcacaataaaataaagtaaaataaaaaataaaataaaataccttgtcttccgcacaagaatataggattattgagagcacagactatgtattttttatatttctaccataccctctcacttataaagcccactgctttgcatattatgcacactttaaaaataatttttcaatgatgaatgaatatataagtgaatgagtgatcaacaaattaatgtattaattctggatgtacattttcttagcctttatctctattttcctataccacccaatgcaaagatactcacctcttagtagcataatttaaaaagaaagactaaaatatctactattcagccataagaaaaatgaaatcaagtcttttgtggcaagatggatggaactggaggccattatcctaagtgagataactcagaaacagaaagtcatataccacatgttgtcacttatacgtgggagctaaacagtgggtacacatagatacacagagtggaataatagacattggagaccccaaaaggtgggagggtaagaggggtaaggactgaaaaattacatcgtgggtacagtcttaatatatgcatgtaagaaatctgcactggtaccccctacatctttaaaaatgttttaaaaataaatatataggagaaaaagaaagattatacatatccgttataaagtctgtgttttcctctggactccttaattgtaaaaacaagagagtagagagcataaaaacttggacctcggggctaggttttctagtcccaggatccccaaggagtgctggggagtaggggttggaaaacatcaggagttacaccagacagagcatgtaaaaggttgactgctttctggtctggctgaatatgttttaactgcagagttagccctcaaaggtcatggactgggaaatctagctcttgttggttttactcaaatcaaaatgttaaaggacgaatcgaatccaattagtaaaagcaaacttcttatgggctgtaagtaaagcataagggaagcaagccaggaagcatgaccttaaaggggtgccatgccccaggggtgtgaagcttagaggcctcttatgtcaattttcacaaatagaataataactgtattcgcagaaaataactatgataataaacatgtcctgtagcatacaatttacaagctcagccactagggtaaatgcgttcgggtctaaagcatgctgttatgctacaatacagtacttgggacagtcatattatacttagcagatgcaagaatagagcacagctattccactcctccttatgtacgtaaggtacaaaggatgggatagccctgaggaagtctctcttcctgatgtaatatctgggttttttatttcggtaggaaaccgtccacttggtgatcacaggatgtaggttagaagctattttatcagtaaaaataggcttgccttggaataaacatatcctttcactcactagccatgtgatctcgggcaagtcattttcctctccacgggtctctttatctggggaactaagtgattagaacagaggatctctgggtctcctttccacactagggctttctctgatggatgaaattctatgggtctatgaatctgtgttctttgtagcttctacagaactcattttacaatacaagtttggctctcaggatagctcaagaacagattcattcatgttgaggaaaggaaggagaaaatgtttcaaaagttgattagcaaagcaaagaaaggatactcacatttattgacctgcttgaatgtttaaaatgcttcaaatgctcacgcctgtaatcccagcactttgggagcctgaggcgggtggatcacaaggtcaggagatcaagaccaccctggctaacatggtgaaatcccgtttctactaaaactacaaaaaaattagccgggcatggtggcaggcacctgtagtcccagctacccgggaggctgaggtaggagaatggcgtgaacccagaaggcagagcttgcagtgagctgagatcccgccactgcactccagcctgggtgacagagcaagactccatctcaaaaaaaaaaaaaaaaaaaaaaaaaagcatcaaacatctataaaacaaaagttcactcattttttttttaatgagcaaatatttattgactacatgccatatatgaggcaggcattgagccagatgctggtgatacataagaagcttttgtctaatcccattttacagatggaaaagttgaagttcagagagcttggttaagtaatcagcacaacctcatgtagctattggttggggagtctggatttgaacccatatccctctgactactgtagtacctcatgttgcatcctgcgaagtgagtctacagagccaaaaggagtagtatctggggcccaagccttgatctaatatcctgggtattctttctacaagagccactaaaatgagatttttgtgcttcctgacactatccccaaagtctaatggtatctgaaaattctcgctttccttaatgatttttatggaaacatcttctgttaatcatactaaactcttagaaaattgcctttgacaacctcagaactagatccctgaagcctggcccttagatgccacatttgatatttctagaaacaagaaggggacttcatgatatctgaaatcatgagtgaggcacttgaagaaatagctaaaagatggttctcctgcaaattggagtttctttccctaatcttgttccccaaagcccctggcttcttgttgaatttgcatacaagtattcatagaccttgcagagactgggaagacccagagagatgtctctgtgcccatccaaccctccagccactcctgacatgtagccttcgggcctgtgtccttgtattcactcagggttctccagagaaacagaaccaggagggtatatatagacatatgaaagcatatctattatggaaattggctcacgtgattatagaggctgataagtcccacagtatgtcgcctgcaaactggagaagcaggaaaactggtggtttaatgtagtcggggtctgaaggccagagatccaggggagctgatggtgactcccagtgcaaggctgaaggcctgagaaatacagccggggtaggggtgggagttgctgctggtgtaagtctcagaacccaaaaggcctgaaaaccaaaagctctgatgtccaagggcaagaaaaggtggatattttagttcaagaagagagaaggagaatgtgatcttcctccacctttttgttttattcaggcagtcaacgattaggagatgcccgcccacattggtgagagcaggccttctttactcagtctactgattcaaatgctaatctcttatgaaacaccctcatagacatacccagaaataatatttataccagccatctgggtatcccttagcccagtcatgctggtgcataaaattaatcgtcatagcttttaactgggtagttctgattggggagcctgtgttttccaaacctaatggattgaagcagcactgtgtggtcctaaggtaactccttgctcacggtctccatcttatgctagaaggatagaaagagttcttaaggagagcataccaggctaggtgaccaaatagagcttcagcagaagacagtggattagagataaagaatgtgctttgggggtacagtagaaaactaatgagtttgaatgccaacccagcctactagctgtgtacctgggactctagcatcagtgtcttcctctattgaatgaggataataatacttcttttggaagatcgtgaagatagttgctaacacaaagcaaaaacctgttttgcaataaagagtacctgatgttatttttgctttatttattaatgtattatccctcatgaatcatgtaagatttcagaccatggcattctagatggtcacttatagtgagggaagaagaagcttaattgcaaactagagcctgtgactgtatttgatgtgtgtgtatacatgtgtgtggggtgtctgcatatctgtgcatgtgtgtgcacacatgtcctatgtatccatgcatgcatttgtatgctcctgggcctggagccacacctccacgtgacatcctctggaatgactagaagatttgataaacctcccttcttgtgcaggcttccttaaatatggcagtttgaggatcccaattatagactcttgtctcaaaacagcctggaagacataaagacaagtctcacaaacattgtctcattagttcagtaaaaccttgctaatttatcctaattgtggggaaggatcgtttgcatgcaggaactgtctgaaagggacctgctttgataaatagacaggacttacttgtaattagtggtgccactcacacacaaacaatcaatgtgctcaagtacttaaaaatagtttgttctcgtaagtgggttgcacattcccaatgtcatcttgaagccgctaatgcaaggaatgggctgggagcaaggggtcttttattttctttcttatttccaaataacacaaccatctgacagatggccaggggcctactatgacctactcgcagggagagaaagaaacaatgaaggcaaagcagagggttttggcaagaatggggactcaaaagaccaaagtcctaatcccagttcagtctccaggctgtcaggttacattcaatttctgggtccgttttgcctgtaaatgaaagagtttagctaagtggtcttctagcatttttaagtcacactatttcagaactgtaagagatcctagagatcatccaatttaactcctttcattaaaatgtgaagatagtaaggggttctttcaatatagtcacgtgccacataaaattttggtcaacagcagaccacctatcaaccattgtcccataagactataatgaagttaaaaacttcctatcaatcacctagtgccgttgtagccatcctaacctcataacacaatgcattgctcatgtgtatgtgatgatgctggtgtaaataaacctatttcactgccagttggataaaagtatagcacatacaattatgttcagtacatagtacttgataatgataataaacaggcctgggcacgatggctcacgcctgtaatcccagcactttgggaggtcgaggtgggtgggtcacctgaggtcaggagttcggcagagtggccaacatggcgaaaccccgtctcgactaaaatataaaaattaggctgggtgaggtgcctcaagcctgtaatcctagcactataggaggctgaggcaggtgggtcacctgaggtcaggagttcgagaccagcctggccaacatggtgaaaccctgtctctactaaatatataaaaaattagccgggcatggtggagggtgcctgtagtcccagctacttgggaggctgaggcaggagacttgcttgaacctgggaggtggaggttgcagtgagctgagattgcaccactgcactccagcctgggcaaaagagtgacgctctgtcttaaaaaaataaataaataaacaataaataagtaaaaatcagccagatgtggtggtgtgcacctgtagtcccagttacttgggaggctgaggcagtagaatcaattgaacctgggaggcggaggttgcagtgagtcaagatcgtgccactgcacttcagcctgggcaacagagtgaggctccatctcaaaaaaaaaaaagataacaagtatgtgtttactatactatacttttattattattttagagtgtgctctttctacttataaagaaaagagtttactgtaaaacatacgccatgttaccccaacagcagcctcatccatcttgtgtttaccatgtctcttgatggtgtcgttttctcttgtgcttgatttagtctcatgttgttttgttcatcatggtccctaagcacacaaaatccactgctgatgttgccagtaacaggccgcatcaagtgattgacctggaaacaaaattaaaagtgattaaggactacgaaggtggaaatcagtgatggttattgcttgcccgtcaagcatgtcacatgccaccatagctacgatcttgaagaacaagaacaaagtgatggaagctattaaaggatctacttcattgaaggcaaggagacaaacaaaaattctagaagggtctatagcagttatggagaaactcctcacaacttggattaaagaccagatacagaagtgtatccctctcagcaccatggcaaccatggccaaagcaaaaagcttgtttgcaatgttgaaaaaacaaggctggacctgactgtgatgttgaatttactgctagctctagatggtttaaattattcaagaatcattattcatcacataatatgaaagtgagtggtgagtctgcatgtgtgagtggtgactctgcatatgctgatgtgaaggcagctgaaaaaaattttcaaactagataagctgattgtggggaaaaattatttgccagagaaaatcttcaatatggttgaaacctccctattctggaaatggatgcctgaaaggacttccatccataaggtgactaagtcaatgtcaggtttcaaggtttttaaggacaggacaacagttttgcttggaagcaatggtgcagactagagctggaaacccttcatgatctggcacagtgaaaaccccagggctttcaggcatatctataagcatgcagcgccactgtactacaggagcaattagaagtcatggatgacccagctcctcctccaagatgccttcctgaattgctgtctcagtgaaatggagaagtgctatttggagagtaacatacctttcaagattttgttcactattgataatgctcccacacatcctccttttactggtgattttcatcccaagatcaaagtggtgtctctcccttcaaatagcacctttttggtccaaccaatggatcaaagagttatagcagctcttcaggcctactacctggacataacatttgtatctactacctggacaggctattgctgaagctgaggaagacactgagatgacactgatgcaattctggaaggattacaacatctaagactgcatcaagaaacttgcttgcgcttgggctggtgtcaccaaagagtgtatgagtgacatctcaaagacactcaagaggctcatccatgacttcaaaggatttgccaaggatgaggaggttgcaaaaatcaacaaggctgtaagctgagatggcaaataagtttaacgtgggtgtggatgagaatgacattgaggagctcctagaggtggttcctgaggaattgactaatgagttgttggaactggaagaggaatgcaaaactgaagaagaggcaagagaaaaggaaactgcatgagaaggaaaagaagaactcccaagaaaattcatagtgaagggtttagcagaagcttttccagacctcaacaaggtcctcaaaaagtttgaagacatctcccagctacttgggagactgaggcaggaggatcacttgaggctaggagttagaggccagcctgagcaacatagcaagacccccatctctttttttcttaaaaaagaaaaaggtttgaaaacatggattccaataccaaaaggttttttttttttaatagagaggaatgttcatcgtgcattatctgcttacaagcaactctgtgatgaagagaggaaacaaagcaagaaatccaccctgaacatatttctgaaaagagtgacagctcctctagaacagcctcaggcagggccctcaggagatatccagaagaaggcattgttatcacagatgacagctccattcatgttattgcccctgaagaccttccagtgggacaagatgtggaggtggaaaactgtgatactgatgatcctgaccatgtgtaggcctaggctaatgtgcatgttcgtgtcttagtttttaacaaaaaagtttaaaaagtaatacaaaaataattaaaatttatgaaaaatagaaaaaggcatacagaataaggatataaagaagaaaatatttctgtatacctgagcaacgtatttatgttttaagctaagtgttactacaagaatcaaaaagtcaaaaaattaaaagtttataaagtaacaaagttacagtaagctaaggctaatctattattgaagaaaaatattttttattaattcagtgtagcctaagtgtccagtgttgctaaagtctacaggagtgtacagtgatgtcctaggccttcaccctcactcaccactcctcactgactcaccaacttccactcctccaaggttcattcatggcaagtgccttacataggtgtaccattttaaatcttttatgctatatttttaccatactttttctatgtttagatgtgtttagatacacaaataccgtgtgttacctttgcctacagtattcagtacagtaacatgctgtagatgtttgccacctaggagcaataggccatactatatagcctaggtgtgtagtagaaagtttattttgccaaggttgaggacgtgcccgtgacacagcctcaggaagtcctgatgacatatgcccaaggtggtcagggcacagctccattttacacatttagggagacatgacacatcaatcaatatacgtaaaaagtacataggttcagtctagaaaggcgggacaacttgaagcaaaggcagaaggtgggcaggagcttccaggtcacaattaggtgatacacaaagggttatattcttttgagtttctgattagcctttccaaaggaggcaaatcacatatgcatctatctcagtgagcagaggagtgactttgaatagaatgggaggcagggttgccctaagcagcttccagcttgagctttccttagtgatttgggggtcctcctttcacaccgtctaggtttgtgtaagtacactctatgaggttcccatgacgacaaaatcacctaaagatgcagctcttggatgtatccttgttgttaagcaatgcgtgactgaaccttctaagggttcataggctataaattatgaaggttgaacatatgtttaatgatgtatatgattaagataaaggctcaagaaagagtgaaactggaagtacttgacccagttcaaggtccaagcagagaaaagatgaacagccaacagggcacacagagtgcaggcaatcagagaagacagaaatgggtaatggggtagagaaatgaacccttgaaccctgagctcaaggagcagaataagtctggggtcaccaagggagcaagaaggcaggtgggaagcccactaggaatcaaggacacagataagagtcttagtaaagaaaggcaaaactcagcaaaaatactgcaccacggtcccaggtcatagaggaagaggatgaggcttgacgggagccactggctcagccagtggtgatcattataaggctggaggtccaatggcatcttctctgattaaaggagattaaggaagctctgggcttgtgaattgtgtcctcccctctggaggaaagtagaataatggatagagggatgggctgatggattgaagggggctccgtgtaatttttggcatccaggcagaaatggttccgagtggcaggaaacagtgccaatggtcccgtgagcctgaccagagcaggagctgaagatttgagagtcctccccacagaaagcagcactgagactgtgagaatgaacaagctctctgcagagacagtagaaggagaaaaaggaaggtcaaagatgatcttagagaacactctcttctcgctgggtaaatacactaaaaggtgacctattctcttcccttactagaggctaatagtgaagcatatattgaggacaggtgggaaacaagacgagtggcattttagaggtgacaagaataaatatggctcactccttgggttgcacgttatcagattcgcccatctgtgtctctccttcgcttacattactattcactgatgagatggcatctccattgtctccaggatgcaaagtacaacaaaacaagtccctggtgttctttgccttcagagataggtgtggattgagatatgaaagccacggaaataaatcagcccctagaaacaaatgcttgtatgttcctttctccctgggaaattgcattccaaggaaaaatcagcaagttctgttcttttcttgatctggttttctacctgagcattctcaagcctggtgaccttgaggctgtcagctggggcagcaatctcagaaaggtctgcccgcctccagaatgcctcccttctcagcctgaaactcatagaactaaaaattctcatctgcccattccccacttttctaaaaatgtaaagaataagtccagagagaaaaaatagtttgatcaagatcatcagcgcatatcatggattagatagtatttctcaaatcagagtactacataagcctcttttaaaagagaaataaaaatattttataagtccctataatatatgcatatacctcgattgaacactgacttcaggttaacaattcgcagattggttcagggtgactgagctgtgtcatgtgctccctgcccactggctcctatcctgagctccatcgggcttgttacccctcatggtccactccatcctgagctcctggcaggccttataaaaagggctttccagccgggcatggtggctcacacctgtaatcccagcactttgtggggaggccgaggcaggcggatcatgaggtcaggagatcgagaccatcctggctaacacagtggaaccctgtctctactaaaaatacaaaaaaaaaaaaatagccaggtgtggtggcacgtacctgtagtcccaggtactcgagaggctgaggcaggagaatcgcttgaacccgggaggcagagtttgcagtgagccaagatggcaccactgcacttcagcctgggtgacagagcgagactccatctcaaaaaaaaaaaaagaaaaagaactttccctgagtacctttgcctataagaatcttcccaggcccacctgtagcctactcactctttctcctttgatcatggtgggatatctttctctgcctctagttatacagtctctgggacttcttggtttccaaagctactctcctagtaattggtctttatttggcttaattccttttttcagctccacactcacccagagatgaggtagaaaaaggtggaggagtctaccaggtgatgcgatgagcagctaggccatcatgacatgacacatcggtgaaatgttaggggtccataggaagagggcatagccctgggaagctctgaatggaaggtagggtagaaaaggctgcaggggtcaaagggtgtgtagggaattgatccacagcatgtgagaactgaatggaccaaggaaagccctagacctactcccttactttgcatataaagacagtcccagagatccaaagagccttgcttggttcctcgtgggttaggagaccataaaaggtaacagttaagagcagtggttttgaagttggacaggcctgggccctgaattcaaactcagcctctattacgagctgtgtgatcttgagcaagtcatctgactttcctgaatttctgtttcttcatcataataaacctacttcatatggtaggggcgaatgttaaatgagataatggcttagaagtgcttaacacaatgtctgccacttaataagagttcaataaatgttaactgtgaataatgacaaaggtggaattagaaagtcaggtcttctggatccttcatctggatgttgtatatctcacccaaaggagacaaatttgattcataggtttatttatggttgaacctggcagaaaacatgctcttctaagaagataaagagctgcttcagatcagaaagttgaatcgtaggcagttagacacgtttgctggagagttgaaggacaggtctaccggtccaggactgaggatgaaccacaagtgatgcagcacgcggacttcatgcacaaaataagatgtgctgctaatcaggacagctgatacatggacaaaaccagaatgtgcagaagaagaaaaagaacagactgtgccaggatgggaagcaggatcattatacaggccagatctttcatgaaaattctgttgtaacttttttttttttttttgagatggagtctcactctggctcccaggctggagtgcagtggcgcgatctcagctcactgcaacctccacctcccgggttcaagccattctcctgcctcagcctccgaagtagcgggattacaggagtgcaccaccatgcccagctgatttttgtattttcagtagagatgaggtttcaccatgttggccaggatggtctcgatctcctgatctcatgattggcccacctcggcctcccaaagtgctggaattacaggcgtgatccaccgcacctggccttgttttaactttctaatacagaaaatccatgaattgggtaccctcccagctccatgcaggctctgcaaaggaacacaggtacaatcagcaatcggtcagcttctattcatttctatgaggcctctcagaatgaggcttctgagcctaagaggaacctgtttactgaaggcaaacttggagacaggctgggaatatctcagctcatagcctcgtagattctcattccacctcaaatcctaacaagtccttatacaaaagggttcctggaggaagaaatggaaacaggaggtgagggagggatttgggagatcagagttcctagggaggactagagatgatccagggaggctgatttggtggaatgatgcattccttcagcctttgctatagaggccgccccagacttccctacattccatcctgggggaacaataggtgttgacttgtcccaaggtcgtgctcatcagtaatagggatggagaaatgtcactctgggccttgtcggctctgcaattattcaaatgctttgcttataatacaatcacagctcctagctctgattattggcatcatcaacatcatctattaatggcctttgagctcctctgggtacatggcattgtacaagatgctaaaagatgccaaacacagactcagaaaccgaaagaggaaaaagagcaggaagtggaccaacccaggcatcattctgagtagaaagatctaaaccagccgaaatccattcatgtgagctaatcttaaagggccaggacctgctaagtaccagaagggcattaattattccagggtcttctatcatttctatcttcattatttcagctgcctatttttaactagaagtatttaaatttccattagttttccttttatcccttttgttaagtaaaccctctctttatcacctctctgcctctcccagtgtggtggctgtctgcagagtgaagaattagaaaaactctaacagttagaacaaaataaataggtaaaggagggctagcttccaaattggccagaccttgctgtgtttgcacagtggcaccttgatacctggcatttctctttgatggtgccgtaggaactcaacacaaagtggggagacacgctttgctgaaaatgccccgtcaccccagcatgaaacatgttccacccaccgcagagctccaaacagctgttctgcctcctttcatgcatgtgctttttagctgatggtgggagacagcatgccagaaacatctgagtttccaccaaaggcatattgtaggttagaagacacagacagctgctgttgtattgaaaacctgctcatcagagtttcgaaaggaacagatatgaaaggttcaaatgaccccttcagtgtttctccatctaactagaccttaagctctgcctctcattaatctttaatgaacaacaaagaaaatgtgtagctggctaattattgtgtagggtggcagatgcttagcgaggaaaagtccccagagtcacgtcatttaaagagacattgtcaaaaagaatcttattttgaaatggcttccctgacctgtagcattatctattcttttaaacttgaactacttttctctcaacattttgatcattgtctccgtctagggcatttgagctttaaaagtcttgagcaatcaggtgatggaatcccatattcgtcccctacaagaaattctcagtcctcctccttggggctgggtgggaagacttgagtgctgcttttcctcgtggcatgatacctacctggaacatctttcttcagttttctctttccccagttaattcattcatcctgtcccatgctgcactgggctctcactttctttgatttttctcagcatttagacagttttagtatgaaaactcttgaacacaagttcctccagggcagagactgtctcatcatctctgtccagtacttactacaatgcctggcgcacactatactcaataaatgtttgttgaattcaatgaaattgcttataggtgccttgggcttatttgctttttatttcatactactctgcagttttcaccactaaagattccttgaaggtagaattcttgtcttattctttttttgccctacctctagaacagttgctacacattgatgtaacaggttctccacatgctggatggccttgttaattgttgtttaaagtcatcttgtatatcaactctgcatgcactgtaaggtgttctgtttgagtaaatatttatatgttatttatttaagaggaaactaggcaagtttgattagagctctttttttttttttttttttgagacggagtcttgctccgtgggtcacgcaggctggagttcagtggcatgatctgggctcactgcaacctccgcctcctgggttcaagtgattctcccacctccaccttccgagtagctgggatttcagccatgtgccaccatgcctggctaatttttgtatttttagtagagatggggtttcaccatgttggccaggctggtctcaaactcttaacctcagacgatccacccacctcagcctcccaaagtgctgggattacaggcgtgagctaacatgcccggcctacaactccttttatagacaattttatttttagattgaaatgcaaggatgtcagtgctgtatttttaagattgtgtttacttcaggagtcaataaaaaaattttttttttgagacagggtctctctctgttgctcaagttggggtgcagtggcacgatcattgctcactgcagcctcaacttccctggctcaaatgatcctcctacctcagcctccccagtagctggtattacaagcatacactatcatgcctggctaattttctttccttttcttttcttcctttttttttttttttttttttttttttttgtagagacctgtctcactgttgcctggggtggtctcaaactcctgggttcaaatgatcctcctgactcagcctcccaaagtgctgggattataggtgtgaacaagcatgccagcgcccccaccctcccaccaattgttttaatttaaaaagattaaccgcagtaacattctaaacagttgttgaagaagtgattttggaacctttggaggagaatatggtaattccaagtgtcaacacaggctcacttagaataaaaagaccctcttcaggagcgtcatgagcttagtagggtagaggaatggaacagacacagaataacttgatttaggcaacccactggacaatgctttcctgatattctggtaggtgagtctgtggcaaattgaacacttttatccaaagaggcatagtgagtaagtcttgcccatctggaaggcatctcagataaaagtgccaaaggattccgctttggcctttggcttttctgtgtttttgatgcgtgactgagagggtggcagaaacagaatttaacatttgttcagcacttaccaccttctaggtacggtgctagaagctgtgtggttatcatctcattttatgagtggcctggtctgctgatgattcaaagctcaggagcaaagccaacttcacagatgacagactaaattctggcaaccaagtagttaaaatttgctgcagaaagcaccatgcccccacactcaggttcaaaacaaccagctgctttgagccacaacctacagaatctaggagatctggttcggtaatcatttgtgggaaaagaattgggggtaacaaagagggggtagggaggaggagggatttgtggtgatcacatgtgaacagaaagcgatggtgtgctggagctgcttggcgagagaaccctccaagaggctacagatgcatagcccagacctcagggagaactggccctaggattccctgcacctgccagaccagtacaaggtaccaccattgtcctagacttctgtagctgaacaaagcttcaagagtcatctagctgtattttggtcatcagatttgaagggaacagacttaaatccagaagagaatgaccatatcaaaatgggcactagaaaccaaaaaatagaaacctattatacggtgtatcttcaaagcactcttctattcattctaccatttaatccttcaacagtcctgtgaaagggttaataaaataaagaaaccacaaggaaagaagtggagtgactcgcccacagccagccagtgaagagtctggctcttgagttgggatctccagaccatcactcgggtattcttcctctggaccatgctgtgtctctatgcacaagcatctgctcacgctgggccagacgccgagtaggcacaggcctgtggggaagttgttctgcaaggctcacaggaggccagaggttcccacagcccataaactcccagcccttagccagcccctggccccccacacaatctgacccagagcagctgtgtaacaggcacgggctgtttgtgcctctggctttcagcagagtttgggctggagttcacctgggaatggctctgccaggctttcactcaacacccgctgccaaagtctgccttcccttcctccactgatctcttgtgaagggagggatgtaaaacacagcccaactctaacctgcggttcccaccagcccggccctcagagctgccccggctcccagaaacaataccctgattatcattcattatttctacttcttagtattaaaatccttttaatatggcattgaagaccactggggagttttaaatttcgtgtcagaccaggatttataggccagttctgaaattttacctctgggctcaataattgcaattcccttttaatcgctctcttagacacctctgttaaaagacttcaattatttccacactgtggcccatgagacggccaatttgaatacccaacccatgtcacctccttattatggaggcctgcgtgggaggcgctagacaggaacttggtctgaaggtactaggtctgatgtgctgtcccaaagggccttgggatttttgggaaaggagtctcctctctccaggagtcgtgagttcagggatcataccccacccacctctgttcttccactccccaactggaagcaagtaccagatgtgttaggatgtatatgctcactgaggcttgttttgaaagctgtacaattctatgaacaggcaaatgcatatactgggaatccttccatgggaaattgcttaaaggaatatgatacagggggttggctgggagggtcaaggcagttagagatctttcagctgagctctggagagtcctgtggtgcttttgggaaagtaacagcagacactacctgagggggttgtggagtattcgaaagagactctcaccaccacctccaccaaggacagaaagaggacacaggatcagccacagcctgcaaacagcggccacgtcaggagaggagagaagagcagcttgctcctcgaaggcccaacttgatcaggtgtagtgaagggggctgagacaggagctgagggtgggagtagctaaaggagccacctccaggatgccatttagtgctttgtatctgatgacagcaatttgtaaggggtaaatgcataactctgtaaccagagccactaagtgctgaaagaaggtttaattgtgggccaaaaacatctgctttttttttttttgagacagagtctcactctgtttgcccaggctggagtgcaatggtgcgacttcggctcaccgcaacctctgcctcccaggtttaagtgattctcctgcctcagcctcccaagtagctggggctacaggcatgtgccaccatgcctggctaatctttgtatttttagtagagacagggtttctccatgttggtcaggctggtctcgaactcccaacctcagatgatctgccgatctcagcatcccaaggtacccggaccacaggcgtgagccaccacacccagccaacatctgcttttattgggagatagtggactgaatgagaggcagcactcaggctgggaaaaggggacttcataaaagaggcaagggcaacaaagaaaatctaggattcagggtctcgcacattgtgatcaaagtcttgttcttgggtggcagcagacaagagggaatgagactccccagccttggtaaggaggggtcccctgggacctcggtcagcagccttgcatggtaacataagggatgtctgcactggaggccattaatgggttggaccaaagcgagaagggtcactcaagagcatggatctcccaatacagcaatgggctaagctattgtgtcccaaaacagagtgctgtcaccccaggatattcaaaatgattacctgcggtactattaacatggcttcttatatttatcactaattttaaaataagatattgaattttactaatacttaatatcagactgacaggagtatatgcgcatgctcaaaagatttttataatacatgaaaatgaacgaaaaaaaatcttttaaatgagatgatgtacctgacaccagaagactcagtggcatatgatttaactcaacatggggctccagcccctggcctgtcaccgagcccatgcccacaaacatacacggagccaagtcatcatggatgaggcctcaaggtcccagttatcctaactcagttggtaagatgccatgaggatcagcaccagactcttgctctaggatcctagtgtctgtgtcttttcctatcgaaaaaatgggcttttatttccttctgctttccatgcctgttttctcatctgtaaaatgggaagagtcttgcattatcccagtaccacaagaaccaatgttcattttcacccatgtgaaaatgcaaggaagaaggagactcccaggtccggtttgtcccaggctcctccacacatataagcccctctcatgcccctaccaaaggaagacctcataaacggaagagacatcaccggtcaggctccacaggcacacacagcaggcagacaccatggtggccaagccccatgctctgaggcacttcccacttgcaggagtcttcaaggggtggataagggagtgccagcctagaaatcccaatcccaagcccaagctcaggcacacactagctaatcttctgagcatgccctgtagctcttcattccgcattgcctggctatgctacaaaggagacacgggcaccctcgtgccttttgcccagggtggctgtaagaatcagattagttgggcggtgggggttgtatgtgtggaaacagggagccctcttagatggtaaagagtgtactgagctgagggtcccctggctgtcccaaggactcacccttgctgtggactcggaatttgacagatctaggttggaacctcatctctgttatttaccaaacctagaacaagataattcacttgctagaatctcagttttttaatctgtgcaatgggaacaacaattcctacctcttagagctcctaagagattaaatgagataactgtgaagaattcctgcccagcgtctgacacagagttagtgtccaaggatggcaggcgctaatgtaactattatctaatgtcagtgtaacaagcaccaccgtcaccacttggatgacatcattggcaggtttccaaagccagagactcttgcagaccacagtctcgaccattttcagatacccctgcagcagctcctgccacacaagcctcaccctgtagccatgaagagcctgagtgtccattaactgccttggagcagaggccaccagcgctttgaatcagaggctcagagctgttttgaatgctgtctctgaacctgctctgagctgtcagcagaactttgcaaccacccacagaattcacaggaggtgggagctcacatgccagattccatctttccagcctttgtcacggtctattccagagtcctctgacctcggagaatgctggaaactgggaaggaggaggggggtcctgctctcctgcccagctccataagaaacatgccgagcaactgaaaagatgccagcttctgtgacctatcacaaaaaggcctgggtgaagacatgggttttacagcctcatccccaggagccagtttttatggactctttggaggtttctgcttggtttgcttttaagaaaactgcattgccagctcaccagtggctatagtgacacttataaaacagtgggtgtccaggaagctctgtattaagacactttgcatacatctcttgggagacaggtaaaggaagtgggctattcctgttttggagatggccgagcccttatcaattaaatatatcactgaaggactgaaccagccaaaaactgggagcagcctgtcctttccagaaaattacagcttccagtgtattaggccagggaccatgtcaaatgatcctgagggtttggggctttcttactgtattgattcaaagtctgagagaaatgagaagatgggaggaaacgctggcctgtgcccagggattcctgccccctctagccctagcccccatctttctggctcctgcatgtgcccctgcctctcatgcaggctcagcatcccttaaaagttccaggtcacaattttgagctgaccctcgaaagtcatgaaaattggcagtggcagtcccagcccagaaattgactcccaagtgaacatatcgttggcacaatctcagggcctcaagcagttctgtttgttatgttcgggaaagctcccatatggctgatacagcagaggcctgaattctgaattccaaattccattagtttcctcaagcatggcttaaaggtgtgagcatgagcctgggcaaatctaatgggcccttgattcctgcattgttagcaaacacttcctagtatcattctacagaggggcctccctgaagggtatggtgatagtattcatctgggaggcagaggtaaacgtgtagaaaaatgttctgtacaatttctggccacaaggaaaatagggctgctttgcaagaaataagttgttttctcagctggtctgtccaccaggctggtcatcacatagaaaatgataccattcatccgaagtctgcaaaaatacttttaaagtttgtttctccagttagtggggatggttttgaatgatcgacctgtattagtttgcaaggactgccataacaaagtaccagaaactggtggcttaaataacagaacttcattgtctcacagttctggaggctagaagtccaagatcaaggtgtcagcagggttggttccttctgaggcctgtgaggaagaatctcttccatgccactgtgcttctagtggttttctggcaatctttggcattccttggtatacatcaccctaatccctgccttcatattcacacggcattctccctgtgtgtgtatctgtctctgtgtccaaattcccctctgttttataagaatatagtcatattggatgggtgcccaccctaatgatctaattttaacttgattacctttataaagatcctgttatcacataaagtcacattctgaggcatggggggttaagacttaaacatacctttttgagtgagtcacaattcaaacaatgatactgcctttcctgcccaccctactaggaccgaaggaagccagccaatagtggcacatgccaccttctccaaaaagcttttccaaaaacttctcagacagggtttggcactccttgcccttgtcccctataccagttgcctggtccaacctgggaggtgtattcctgaaaaacaccaagatgagccttgatcaatgaggagtagccaagtagcaaaaaaaaaaaaaaaaaaaaaaaaccatagtaacaaagggcctctgggtacagagaacatcatgagcaaaatgtggaggatgaaggagccctggtatgtgcagggagccagaggcaggtcccgaggccattggagaactgtggtcatgtttgagggttttttttgtttgtttttgtttttgtttttgagatggagtctcgctctgtcatctaggctggagtacagtagcacaatctcagctcactgtaactctcagcctcctgggttcaagcgattctcctgcctcagcctccagagtagctgggattacaggcacacgccaccatgtccagctgatttttgtatttttagtagagacagggtttcaccatgttggtcaggctggtctcgaactcctgacctcgtgatccgcccacctcggcctcctaaagtgctgggattacaggcatgagccactgcacccggccatgtttgagttttaaagagattattcctgacacggggtgtagaatggacccctcctcgggctgaaggtggatgtgtccttgggtctcagttcttctctgccatattagaggattagacacagtgatttccaaggctcagacccctcttaacatctatcaagcctgcaacagcgttattatccaggatacttgccaccatggagtataagcagcacgggagggcttgtgagccttttttgtaccaagagggctcagagcaccatccatcaaagcctctgacaattaccttcccattcctagtgtggaggtggaaaggtgtgatccctctcctcactcatcacaacaaccacagctgacacacctataacaaaaaacaggttaacgagagaaaaagcaaaacaaacgtatttagtcaaagttttccatgacatgggaggcttcagaaatgaaaacccaaagacccaggggaaattttctgtttttatgcttaggttcaatgaagaacagatagctgtgtagaaatatgattaggcaaaagggtatgagctaaggctaatagacagaagggggaccccaaaaaggcctggctgttggattcttcttggtctcttgtctagcactccttcctcactcctccctggtacagggcaggaccctctggaactagggtcttaagatctgctatccaacaaggtagttcagagaattctgttatggacagctctatacagaaaggcagggggaaggttagagcaacaattctcatttctatggcttgccttgggggagaaaggggagcaggggatagaaaggcaggagagggtcagagagaacttgcttctgaagaccctccaatgtccttcagtttaaagtccccatcatgctaaggtgccataccttggggtcatgttctgagttccaaccatgaccaccccagtgaaggggcagggcatagcaaggtgtgggtgggggaccctctctagcagatacaagtctgtgagctattcttaccccacctcaccaggctcctccaggcttttctggctgaccacttatcccagccccagaatttgcttacaggaccacagtttatggcaagtttcaccctactgtataaagtttcagcacagtggcttgacttggccagagatttatggctgaaatggagcctttgggcttgggtgtcagcattttgcttggctcagaggcttgcattcgcatttgaaccaatcaatacatgcaggcattaagtggtatttaggctgcctctctagggaacaggatgggctgctggaatcatttgagcatgggcagggaggatgcttctaggactgggaaatcccgggagctctgaagtgggggccctggatgaatgccccaactccagccctgctcaagactcaggcctcaagctggaggcagactggactgaaggagggatcccacagaaacggccacatttcagtttcaatgttgtctttatccttctccatggggatgatgtattgaagaaaaaaaaaaaacctactgcattgacttggcttgaaagaaaagattgtatttgaaaagaacagatggtgctaaaaagttattggaagaaagagagagttaggaaaccaaattccagattcccactggctgctggtgggtgatgtgcccacatctccttacagaaagagttagaaaggcaaaatgatcacctgggactctaatcacagaaaatctaccacccaccctgccagaaagattgtctggcaagtttgtggagtggaaaacccccactggaatcccctcctgtggtctcttctctaattctaagtgattcctggaatgccagcaccatccacactctctcccctctcacttcccctgcccagaattcagctgggtccctccccacagctccctggtgagggatgctcagcagatgctggaggaggaggtggcttgcatgggacctaatccaaaatttagagaaacagaaagaggaaattcaggattctcagggtcactactcttgattagaagtcttctcttgcttgatttttttctttctttctttcttttttttttttctggtctggataatcagtgttttttcctttaaaaagaagaaaaaaaccactgatgcatcttctatatattttttatacaaaccagagcaaagaagaatccctcttagacaatactactgggaccaattgttgtttgggaatcaacttagatccttatatattttattttaatttgcaacttctaaatgcatgttaatccaccagtgcttgatgtagggccaaattagtgtggtgtggtctgttgattagagttcctcattgtctttctcataaattacattcataacacctcatccatgatgttcagtatccatttccttaaaatggaaataatttttaaatacttgtgaagtaatctgaaggctctctggagactttccgggtttttaagatttgtttcctgatctttctgttgccccattcacacctaattcaacagtaattatttgtggtgactcaccagctaccagtctttccaaagtattcaaatgttctcctgcctatttcatccacttaatgagtacagctggcataaactgttttagaaactgtaggggcagaaagatgtgtcacttttccttacccatcacaagggtcactctggacactcctaggacaaaagacaggaaagcaagaggaaagcaaaacaaatttgtttaattaaagttttacgttacttgggagccttcagaaatgaagacccaatgtctttgtttggtttgatgaagagtgagccattgcagaaggggatgggacagaaaggggatgatccagtggtgacggactgagggggaaacctagcaagcctgtgggttcagattctccttggcctccctgtctaacatttcttcctcctgggtgtggagcaggacccctatggaatgaaggtcttcaaggcagcagggagagaataaccattctagttttatggcttgctccaggggagaggggtgctagttcctatgactgattttggggaagaggacttctggtttctacaactcacttcaagggagaaagaggggcgagagacaggaggggaagagaaggtcagacagaacttgcttctgaggcccttccaaggtccttcaattcaaaggactcagcatgccaaggggccatacttttgggtatcatgttccgagtctgacagaataagcataactgactctcagtgggtgtggaactcaaatgatgggagtagggggtctaggggtactaaagaataaccttgagcactcagtaaccttgaacacttagtaaccttgggcattcagtgaccttgaacattcagtgaccttgaacactcagtgaccttgagcattcagtgaccttgaactttgagtgatcttaaacacagtaaccttaaatactcagtaaccttgaacattgaacctcagtaacattgaacattcactgacctttaacactcagtaaccttgaccagtcagcaaccttgaacattcagagggcacagggtatttcacggcatgtaaaatgtagagcttgtgctaatccagcaagcaaattagtcacacgaagtccagttaagaacatttctactactatgtttttcttacaactgtggttatgatcagtctactcctactcctccccatcccgattgcaatgatttagaggctaagtctgtagaggtagactcttcgtctcctaccttctggcctggtacacagaatgaagaaaaaatgctcagccagggccagggtggacatcagcccccaacaagcctgcatattccagtccagattctgaagatgcagaggtcgagtagaaaaggaataaggtagcctgaggcaacaatgaaaggggccaaaatatctacaggatgcaccctttgctagtatgctgttcttcaagcacaacccacctctgacccaccaaaagctcttctaaaaaatgagttacttgcatttggcatacatctaaacctatgtgcattatagtaggaagtgccagagttttgaagatagtcttgggttcacgttgcctcctagtacttactacatgaaccagctgtgtcagctctctaagcctcaaatttctctcttataaaatgaggatgatgatatgtttcatgcatttgttaggaaaattaaataagattttcatatttaatggaaggagtcctgaaacctttatgtctggaatgggaggctcttctccaaaacccccaaatcccaccacacagtcaatctcttatttcaccttcttataagatcatcagccacactggatttaggagagaaaagaaacactagcataataataacaacagcatccgctaatgcttattgagtgcaaactacatgcccacatatctcaacccatgtgatcttcacaatacccctttatgagtcaattagtattcccacttcttaattacaaaattcaggcacagagaggttaggttaggtagctggcctaaggtcacacagccaataaaaggcagaagtgagactataaaactctcagtaggtgtggaactcaagtgatgagagcaggaggtccaggggcctgaggtcacacagccaataaaagtctggctgcttaattattatatttctcttgaaagaaggaaaggaaaagtgagggaggaatagaagcaagaaagagaggagggagacagggagggagggaacaagggaggagagaaaaaaaggggaagttagaagaagctcaaaagaagctaggaggccggtgcggtggctcatggctgtaaccccaaaggaggcactttgggaggccaaggtgggcggatcacctgaggtcaggagtttaagaccaacctggccaacacggggaaaccccatcttgactaaaaatacaaaaattagctgggcatgatggcgcacacctataatcccagctacttgggaggttgaggcatgagaatcgcttgagccaggaggcggacgttgcagtgagccaagatcgtgccactgcactccagcctgggtgacagagtgacactccacaccaccaccccccccccaaaaaaaagaggctaggaaaaggagctcaggaccatttatgttgtctttgttccgaaacatgagaaaataattaaggaaatgcagtttggaacatcttctatgcctctaccccaggaaggccagcctaccttccagatccccgtcacccacataacatctctgatgaaatgaaaactgctttacagctgacaatgctaaggtctcaacaagcaggcctgcagccccagggaacccagccctgccttggccccccctacagagcctggagcccccttagcctcagagcagctcttctccacgctgggccattggaagccagatcccctttcgacctgaaacctcttcctttcacagctgatcctcttcagagcacattcatctaacttgtgggaaagtatgaagggcaagtgaataataaagccaaggctacttggataaaagactccatgccacacgccatgtgtaattattattacagaaaattaataagcaacaaaggacctcacactaaaatttacattgatctagcatttttcccctgctatctcccataaaaatgctttaaatgcaggctgatttaatggaaacagtaaaaaattgtgctgaatggtttatatttgctacagaattactacaaagtatattttaaggaaaatttgaaagttgtgtgttttttttccctgtaggataagattagagagagaggttcaaatgttttttttttttctctttctttctgtattgatccagacaaactcccacaggctcagttctttgtttctaacaaatctttacaccttcacacctcgtccagacacttgtcaagagagattcttagcaaagacacatgtggaggaatgccagcagtgtggcttgagtcctgacagtgttatgcttgataataatcatcaccacgtgactgtgttctatgtgacagggacttggctggttatctagtttatgtggcttttgtcattgtcgatctcacccgtgagtttgggcatcccagctaggagctcagtcaccatccgaatgacttggcgctcatgaccagcacaggacatgaggatagccacatcttgtagcttcaggtccccagccatgttcatcagagccagaaataggaataaagcctcggaaaaacagtttctaacctcagggagcttaaatggcagaataaaatggtgttctaaagattatagaggcatgccaacctgcattttaaactcagttataagcagcgcatatagtagacctttaataagttttaactcttgttggtcatattattaatgctgctgtaggtagtattcatattgacttggtccaagcctgacctgcattggagagaacatttatgcaacagatggtaactgtcatagttgagaactcaggtatcctccaggtctcaattacataattctccggttccttctgattcgctcttggcaaatggaggccaagagttatgtgatgagctatgtagtaataatgcaaccgccaaagttccccagtctttgcatttctcctaacagggaaggcgtcattatcatgtgaatagatgacagctagtgttcatgaattgacacgaacgtttggattaactcagctccactgcaatataaattttgaccaagagtgtcagaaactcgtctgatttaacagaaatatgttcatttgtcctctcagtcaacaaatattttttgagtgtctacgatgtataaggcattggagacatgtgatgaatgatccaccattctggcattaaggaggtgggaaggcaagacacagaagtcatccttcctgtagaggccaatgaaaaacattggcacctgcaagattggaccacctgttctccaaacacacactgtctatgtggcctctgctcatgtgctcatgccagtctctctttctgcatttctgcattgcccttttcctaattcctgacccctcttcacaacccgtcctcaagatactcctatcctgaccatccatttggagacatcactttggcctcggctttaatagcatatggtgcctacacctctcactcacctctcgtatgctaccattcactaaaaatcttggtacctatgtttattctttctcaccagtctgtaagctccttgagaacaaggctacatcctaaacacttcgcatccctagagcatccaatactttagctagtgtgcaacaatgcaccagtaaatatctgagaaatggaatgcgactcaacaaatgctaaccaagaactagacaccaagcatcttttcatgtcctacaggaagatgcaaaggtaaagaagaagcttttactctaagtgagatggaggcctttggaggattctgagaggagtggtgatctgctatcatagtcaaatcctaatacatcttgtagggatgttctaacataatttcttggggttgtatttaacgtataaagatgcatttaaccaagtttttctttatttaaacaaacgtgatggctgctactcataaattgcaatacctttctcaccctcttttactatattcctttctcctttgacgctcataaatgaattgagatgcagatatttgcaaggaccagtgtcattccatgaagaaagcagtggtttccataggaatagctccgcttatggagctcctaccgtgtgctaagaattattactctgcatgcatccttctcaaaaatccttacaacaatccagcaagttaggcattatgacctccatcttaaaaatagggaaactggagctcagaggaattaaatcatttgcctaaggtcgtagcttagggtggtggatggtggagctgagagctgaatctaggccttgccttgctacactgcagcagctaaaaccatctcagaaaggcattcctttgaaaagtatgtagggtgggtttgagggcacacttaaggaagccagccctatgtcaacatgatgcccactgggatattgcacagaagcaaagtatgatgttccctgtcttgtcaactgccactcatggtcctcacgtgttgtcataaagtgtcccttcattctgggcttaaaataacttggtgcctttgccctcctgagtcacagctgccaacctttcaaactcatcagcggcttgccttgtatcagatgtgccagacagttttctttaaacatatagagctaagctggtagggagctgtgggaggcttagaaattctttttgtttccatgtcagagcttcttgtgatttttttgtagatttttctgacaaagtatttcactatctggccagtgtgtctatcctgataacccaaattgatgatgcctccagcaatgctaagtagacatattcttctctgtctctgagattttagggaaatgaaatgcaattgactgtatagactgatccataggttgcattgcctcttgtgcttgcagtcttggagcaataatatgctttattttaatcctaagtctgcaggtaactcaatgtgtgaccttgagcaagacttcacttctccaaggagggtgaaactgagtctttttgcagaaataaatctgcgattctgtgattaatcattctcctcccacctctgtgggatattatttgtccattggagatttcagggctttcataaaatgttttgttactaggactcctgcaatcagctagggaagtatagatatcagatcaataagggcccttagggaacttttaattcaatgcctgcattttgctaatgaggaaactaaaacccaaagaggtgcagggacttgcccaagcccacgcaaatccacgaccggaatccaggactcagctcccaattcagtggcttttctacatatctcttctagcctgtaggtcagaaatggaccttgatattcacaagccaaccctcctgccttttttgatggactctaacatactcattataatataggcactctgcaaaaatggctggtccgtgtttttctcaaaaaattcatgcaaagttggaggcagaatacaattgatcagaaaacatccaacatttcaggcatttttggagagaagtgccttattcaaagtcatcaggcaaatgaggggcagagccagaactggaaccggagagctccagagagacacagggaagataatggattgtgacaagctgtccatacagtcccctgacttcctaaagtccagatggacaccccacactgtcacattgattgatggaagcaccagtgataagacagtcacaaatccccaacacatggaaccagctgtacgtttgtctccaggaggctctaggtcagaacataaccttcccttctgcaagcctaagtagaattgccaccagccgaagggacaaaagcaggaccctaataggctcattctgtgaccacttgggtgtaagcaaagaaaatggaggcagaccaagaagagagtttagatttgtttttcactgggtttttggcgttctcttaaacaaatctgaccctagatataagcttgcccttttctagtcccaacttccctggatataaaatacatgtttggcaactgctctgaaagttattaaagttgcagcagtaaactatgggaggccagagaatttcagacaaaagttattgcatcggtaactcagaaactaattcctaaaactcttgacacatttatccagagggctagtgccaatatagaaatggaaatcattgtcaagggccgctgtgtacctggaattaaaatccatcatttctcagagcagagagctatgattttggcagaatatgaatactcctgcctttcaccactatctttcctcaaaaataggtcctttatttttcagaagaacaagacaaattcggctctttttgtctttttgtttatctccttaagaaccacttgtttacatgttcttctcaaatattgctatctttgacagtccctcatttaaaccgaaagccctccttttccttcaattgcaccagttttattgtggatggaaatcctgctgggtacggtaacagagaacaaactttacagcagcaataatcccttctacagcatctattgtggggaaactcaatacacttttattaaatggctgaagaattagcttcagtgacctgaattaactacagagagaaaagatagggaagaagactacctccttcattcagcagacacccaccgcatgccagagaccagagacataaagctaccatccaggagcaccgcgctgaaagagatggtggatggtcttaggcgatgccttcatcaccaaaagttagcaaaggcagaaaagatttggtgggaattagtgttagcaagcgcatgcagaaatgggcccccgatttactgtggcaggattgacgatatgcctaaatgtgcacacattttgactctgattctaagaatttgtccttaggccgtatttagataagtacacagagttagctttggcataatcatgatcaagaaaaaatcagaagcaatgcacaggtcattaaaaatgcaatcattaaaatgatactgtaatctatattgtcttgtgacataccatcaagtgagaaagtgcaaccacagagtatatgtactatggtctcattcatgaaaaattaaaatggattaaaatggacaggttgggcttgatgcagtggctcacacctgcaatctcagcactttgggaggctgaggcaggtggatggcttgaatccaggaattggagaccagcctgggtaagacagtgagaccctgtctctgcaaaaaaatgcaaaaattatccaggtgtggtggctcacagctgtagtcccagctactcaggaggctgaggtaggaggatcacctaaacctggggaggttaagcctgcaatgagctgtgatcacaccactgcactccagtctggaccatacagcaagaccctgtctcaagacagaaaaaaaaaaaaaaaaacaacctgacaggttgtttccttaggtggtgactatggttattgctggacaatggtattctaggtgacttttactttccattatcagcctttctgaatagttggattttcaatgctttttattttttacagtgagcatcactttatatttagggggtggaaatatttaaaaaaatttatttaatggaaagctagtttttcccttaatcctttaccacttgtactgccataccaaagcccaacctactggtaaaaaaaaaaaaaatgtgaaatattgtgatgatttcatagatgtataaataagccaaaacccaccatcaaatcatacacttttttttttgagacaagagtctgtatcgccaggctggaatgcagtggcgatctctgctcactgcaacctccacctccctggttcaagtgattctcctgcctcagcctccctagtagctgggacctcaggtgtgcaccaccatacccagctattttttgtatttttagtagagacagggtttcaccatgttgggcaggatggtttcaatctcttgacctcatgatccgcccaccttggcctcccaaagtgacactttttgtacatgtaatttattatacatcaattatacctcaataaaattgtttttaaggaaagaaaatatcaaataatctaggtaatttttattttacacacaaaccactcaaaataagtaagtaaataaatccacacacacacacacactcgcagacatttatgaatcaatgctggaaagtaaattcgatggtccaatcagtgacaggaggctatttcaagaggttaatagcatgagcaaggtgtaaaagtgttcatttaatttattctctattctctgacagtgtcagtatccttgattataggtgggtgccgagctcgccatttcacctgcttccatctttttctgttggcactttttgcaaagtccacgtcagtcttaggtaccttttaccccaaaatacatgcttcggtgcactttaattttcctgcagtaaataaatagttcttactagcttccgtcttaagtaactgtagagcaaacctgagggttccgagactttctatcagataaaattctgaaaaccaatcattctttctagagataattttgaatagagtgatacatgttttgaagacatttccttgagtctacttactggcaggttttctcaactatatatattctttcttgtgatactagctactcaaatagtccaaagagctgcatttgccttaaacagaatatgacaaaaggaatgccagtggtgagactgggttcgtgaattggatctctaagtttgttggactaaaaggaaataagtatttgcatgttgctgtcagaatcactgtcctcagtgccacttcgagtcccatctcttggtgcccatgaagaatgtgagtcctgaagtccctgcaaggacatgaccctgtccacatgttaggcctaattctcatatctgtttctctatgcttttctcctctgttttccaatgcaaccagttggacagtgctccagggaagaatcgggcgtccagacaacccatttcgagtggccctggaatacatctccagtggaaaccgcagcttgtctgcagtggacttctttgccctgaagaactgcagtgaaggtatctgaatctggctttcccacgctccttggtagcctattgtgttagatgtgtcaataacctgcaaccatgtttggctgggaatgtgcacacttatgaagaaaagtctagagtgggctgggtgctgtggctcacacctgtaatcccagcactttgggaggccgagacgggtggatcacttgaggtcaagagttcaagaccagcctggccaacatggcaaaaccctgtctctactaaaattacaaaaattagcctggtgtggtgatgtgcgtctgtaatcccaactacttgggagtctgaggcaggagaattgcttgaacctgggagacagaggtcacagcgagccaagattgtgccgttgcactccagcctgggcaacagagcgaaacccagtctcaaaaaaaaaaaaagtctagagtgttttaggggctagttctgaatgataccaggtgatccatatcccagataatcaatttcaaagagctggtataaaatgatatctaccttgagaacacataggcacatagaagggaacagcagacattggggcctaacggagggtggagagggaagggtgggaggagggagaggatcaggggcccaagaatgaagcgtggacccagaggaagcctgaggcactcccagacctaaattctcaatttaggctattcctgaataactttgaaggcccatgtcccacagtcatctgttccatgtacaggcctggatttgaactttgtgcctctgggaagtggtgtgtgaaagggattctcttagggaggaagccctactgacccctcaccaacccagcttcttttgcccctgtggctcttcatttattgctggctttgcaggaaattttatagtgtattttgttttcgttgtttaatcaaaactggtttatgtgtggggaaaagaaaaatcaccataatgtgatagattgaaccacagttcaagttgaaaaggtggttaacctatgatatgaggcaatgtataagaaacatgtggcttgggagcaagccaggagcttgtacaaatgtttccgcactcatgaacttgaagatttgtgaatgtctctggacatcatcagtcctcacagatgtcaaggatctatgtaccatacaaaagaggccatctgttgaaatggaaccagttaacaagaatgtggcagggagaaagtatcaattcccagaatgttctcatttgatcatcattaggaaaaaggaataagaaactgcaaaagtccagatatcaggcccacaacaaatactcctgcaaaaatttcttgacctgaaaaaaattctttgcatgttaaaatcaaggatctcaagctatagatgttttctcccttgccctgcaactccctctcacctaaaaacattcatcccccatagcctgtgttgcattcgcagtgagtctgttccagagacccgttcctgtctgcttttctatctttacaaaaccaatagagttgacctccctaaaatctctctaattttttctaatctttctaatctcagaaagtctccgctggcagggcaccctcttagaggagggagaagatgagtcttcctctgattccctagagaaagtggcttggcccagatacctggggaagttctcatggtccagcttccttctttcagtggctctagctccaagaacagatggtctccatgaggaggcaaatgttctctgtgattcttctctgggtcagaccgcctgtggtcaacaagggatggggagggattgattgatacggatgtgtaaggcagagaatagtgaagaacaaggtgatctcagtgtttgcttagaacttctaaatttccttcccatagaagacaaattcaggtgcgcatcagtaggcatagacaaattgcagacataagaatcatcctaaaattacactcatatttaaagggaaggggttactttaaaggcatactcaatgtctattcgatgtaggcaaatgtctatgttttctggggtcattgctttggttaagccagaagaagaggggataaaaggagaaaaatggtgtctttgaaggaggtgaatagggctggcaacattactggccaggactgtaggaaggtctgcaggatgcctggtctatatttctgataagaacttggtcccttcatgatgaggcacagatggagcacaaggggaaacacaactgtagaactccacagctcttccttggcccacagcagagacgtgccattttagttcatctggagaaggctcaaggagacatgggacaattctccccgcattggagacaatatctatctgtgggtgtcatcaagacagaggccatgcctgtatcctctctacatccttacacttatcacagtgtgtgacactaggtaggtgctcagttcatctcagttgatatggactaatagcaaaaagctaacattgacagagcactcgccatgcgcaaagccaagtgtcaatgcctttatgtgttacatcatgcaagctttacgataatgctgtaaagcagggactaatatcctcattttacagatggggaaactgaagctcacagaagtttcaaaacttgccagggtcattcagttagtgaaaagtagagtcaaactcgatcccaagttgatctgatgacaaagccagtgtttctgtccactagcctctgctgcctttgtggaagaggctgaggtttcatttatttcctgaaaaccttagcatcatctttgactcttcctgttccttttaccactacacccaaattgccagaacctttacctctagacttgcttttgcctgtattctatctgtctctgtctagatacttgatatggtttggatttgtgtcttccccttcccaccaaatttcatgttgaattataatcctcagtgttggaggagggggctggtgggtaattggatcatggaggaggatctccctcttgctattctcgtgatagtgagtgagttctcataagatctggatgtttaaaagtgtgcagtgggccaggcacggtggctaatgcctataatcccaacactttgtgaggctgaggtgggcggattacctgaggtcgggagttcgagaccagcctgaccaacatggagaaaccccgtctctactaaaaaaacaaaaaacaaacaaacaaaaattagccaggcgtggtggcacatgcctgtaatcccaactactcaggaggctgaggcaggagaatcgcttgaacctgggaggcggaggttgcggtgagccaagatggcaccattgcactccagcctgggcaacaagagtgaaactccgtctcaaaagacaaaaacaaaaacaaaagtgtgcagcagccaggcaaggtggctcatgcctgtaatcccagcactttgggaggctgaggcaggtggatcacgaggtcaagagatcaagaccatcctggccaacatggtgaaaccccgtctctactaaaaatacaaaaattagctgggcatggttgtgggcggctgtagtcccagctccccgggaggctgaggcaggagaatcacttgaacccaggaggcagaggttacagtaagctgagatcgtgccagtgcactccagcctggtgacagagtgagactctgtcttaaaaaaaaaaaaaaaaaaagtgtgcagcaccttcctcattgctcttttcctcctgctttagccgtgtaggatgtgcctgcttcccttttgccttctaccatgattgcaagtttcctaaggcctccccagccatgcttcctgtacagcctgtggaaccatgagccaattaatcctcttttctttataaattacccagtctcaggtatttctttacagcagtgtgagaatggactaacacaatactactgttgctgtctcttggatatacccttctgacttcatattcccagctgtgtgtcttattctttctatattcttcatatacgcagacttgaattttggcagcagccaactggtctccctgataccattccatcttccacacgttgccagataaatctcctcaatattactccttcttttgtggcgctttcatgtgacataggtcatttcttattgcctcccacatcagaaaataatagaaaaaggggcctatactggaccaccttactcatttcctggggccaggaaatgtcatttgcagccacagaaattctccttggaagactttatactctacatctaaatttagtaggtgttttataattgtttccaatttaatcattttgggatcctaacttgaagttcaagaccttgtcttacatttcttttatttctccagggagcagctagcatggtgctaaacacacagaaaacaccacacgaatacatgttgactgattggttaatcaatcaattgataaatgctgcaccttcttttatagctttgggctattaccctactacttccaaaagaaagtagctgtaagtagaaatggcttggaagagatttttcactgaaaggccagtgaaagagcagcttacacaatcagcacaggcaagagagacatcagcccccagagacacccatgcctgggctcccagggaacccttagcccattcacaaaaacctttcttgagcagacaacccagagcaataggatcacgcaggacactcaccgggacccctcaggttcagaggtgcctacagcaacacatacgtcagaatgggaaagactagcttcttgaaagggatttgaaaaggaccagtgtgccaggcgtggtggctcatgcctgtaattccagcactttgggaggccaaggtgggtggatcacctgaggtcaggagttcgagaccagcctggccaacgtcgcgaaaccccatctttactgaaaatacaaaaaaagtagccaggcatggtggcatgcacctgtggtctcagctactcgggaggctgaggcagaagcttgaacccgggaggcagaggttgcagtgagctgagatggcaccactgcactccagcctgggtgacagagcaagactctgtcaaaaagaaagagagggagggaggggaggggaggggaggatcagcatggccctgaacagctcctaaaaatgcacagcattgcaaaccctcatctagctcttccatgcactaggccctgttctaagcatggtacatatattaactcattcaatccttacaacaatgctatgaagtatgtaatattattcttatcattattattcccattattatggatagagaaatcaaggcacggagacctaagtaatttcctcaaagtcacacagctggtattgaaatggaggccatctggctccaaaatccatgttcttagctaccacaccttgcagtttgcacagaagatctctgctggaagggacaccagaaatatctaatctgtctcccttgccatgtagaaattgaatgaacaaagacccaatgattttccttgaaatgtgatacactaaattactgaccagcccaaggtgctttctgcctccaccttatggttgtcaagttctcaatttttctaagaaatcaattcagtatttccctttcccagctcagattgttcagaggcagttgaaatggaccactgccactagtcaatatgaagacaaagagctgcaaaggagctcccccatgaaaaacaaggaaatgtagatagctcctgtgtgagcctacatacattttatagcaggccactatatctcctcttctctttcaggaacctacaaaaacacatctgaggtttcccaggccacagccacattcagctcactaacagatttctcaaaagaagtaatcttcttggttccttactctactgagataatttcatacacattgcttctgattcattcattagagaggatgtcataaccttcaccttacccgtgagaagttatttctctaacttctctggctcaggaaggtgaaggtatccaaagtcaaatgcagtcccattattatggataccttgaaacacatgtccccaaagagtctgagatgcacaaataccattttttaacttctccggggctaaaatgagggtgtttgaactctcttcaaaccttttctagagcctgaagccttaattaaaacaaagtcttatatggaagcccagtatataaaatgatacaagtacagctgtctttgggggcgcctagaacccacctgttccagagcccttgacattccccctcaatggggcttcatgaaatacattttaagaaccattggacagtctgattctaagctctctcttttttttttttttttttgagatgtagtctcactctgttgcccaggctggagtacagtggcgccatctcagctcactgcaacctccacctcctgggttcaaggaattctcctgcctcaggctcctgagtagctgggattacaggcgcaagccaccacgcctggctaatttttgtattttcagtagagacggggtttcaccatgttggtcaggctggtctcgaactcctgacctcgtgatccgcccaccctggcttcccaagtgctgggattacaggtgtgagccaccacgcccggcctcagctctcctattaactccagtttttatggtctggtcctagatgttacacttatttaaaatatgaaaaccaaaaataggtatattaactgtatcttatttaaaaaattagggcttagcacaaggctattagactttgaatatgggccattttcacaaggcaagttcttgtccaggtgggttctggctttgaggtgctggatatgtagctagtataaatatttccaggaaaaaatgggtagcatcctgtaaccttgtccccctctctctccttcttctccaccaaagacaatgttgggcaatggaagatgtctttcttagcctgaaaggggacaagaggaaacgaaagaagctgaacaaatagattcaaatctttggccagccatgtggaaccaatcaacatctagagtaggctccaaaatccagctgggtaaatgagggattacttcatgggctcctagcagcctggcccaaactgggcattttctcttccaacagcaagcaacgcctcagcaggatcctcagtctgtgcttgtaaaatgtagatcacagtggcactctgtcttggggctgccagcagcaaactctgtatgtagcaggctcagctatccatccatccatgcatccactcatctatgccacagacagtttctgagcaagtactaaactgggtacatgctaacattaatataaaatagttgtttctgtcttaggactgaattttggtgtggttcctttaacatttccattctacttcacatagaactctttcttaaagggcatctttgagttatatttaatttgcaccctaaccctaaccctaagggttgtaagggtttgtgcaaagtaagtgcaaatcttacgaagagtttgtaagagttaaagaaagaggaaagaaacacaaaatgcggctcaatggttaaaaacagatttattttagagaaaataaacctgagaggggcttctggccaattttggtcaggagagctttctcttacagactaagagtatatattggttttacagtgagcaggcttatcacaagcttggaatgtttctgtgtgggggagaagtttatggggggttggaatttctctggacggaggagaggttatcttggggctgacatctttccggccagagggagactatctcggggctagcatgtctctggttggggaggagtttggaatgtttctggtcagagatgttatttgtggtttatggtcatgctgaccttggccattaggctgatgtcctttggatttaggtggtttttgattaagatgaactttaggatgaggtgcttgtccaagatggcagtgctcctcctctgtcagtactgaataggtgttccattcctggaaatgtcttcctccaaagcagttccaacattcctttctcagaaagaccacagaatgagcactgaaccagaatcagaaaacctggatttaagtctccttcctacctcttacttgccatagactagccatcacacttcaaatcattaaagatttccctcataactggaacatagattgggtttttgtggggtttttttgtcatttaaaatagagataggccaggcgcagtggctcacacctgtaatcccagcactttgggaggccgaggcgggcagatcacgaggtcaggagatcaagaccatcctggccaacatggtgaaaccctgtctctactgaaatacaaagaattagctaagcatggtggtgggcgcctgtagtcccagctacttggggggctgaggcaggagaatggcatgaacctgggaggcagagcttgcagtgagccgaggtggtgccactgcactccagcctgggagacagcgagactccgtctcaaaaaaataaataaataaaaataaaaataaaataaaatagggataacaacatgtcagtagttgtctcaaaattgacctcatgctgagggtcagtgagaaggtggctgtggaggtgccttgtaaatgatgccatgagctacttaacctctctgggcctcacctcgcctgaagcttttgagaactaacctgcttccttgctgctgctgtttctcatgaagaaattaccattcacagaaacaaactggctcctctgaggcctcctgcagagctttgtgatgttaattattgacctaatgccaagagggtgatgagagccacacactgccaacctggggaggtgccaccacctggagcagtcacttcagggcactcaatcagccgtgcaatggtgagctctattgcttggaagtgatcaccaaggagaaatcgcagtcacgaccttagtatcctcacttagttctagtgcctatctccaggtggatgttcaactccattttaaaaacgctctccttctaaactccctatttccaaaatctcctgcccttaacttaccgtggactgaaccatttaaaagataagcatgaaaattatgatttcatcagccactgagatctgcttgcatttctcaaatgtccctccccagctcaagctttggttccatctgcgccccctgcagcgcaccctccacctttcaaagacctgcacatctttcaaatcccagcttaaatagtattttctctaagtctccactcagaattgtttccatgtatatctattttagaaccgtctacttctctccagttatttatgtgtctcactcaatagatgctaagttcctaaaatcaaagactgtctttttttaaaatctctgtatctcaattagcagtgaagtgcttttttttttttcatggcaagcactcaataaaggtttgcttattccaatgtaggagagagattagaggctttagaatcagactgaatgtatttggatgccagctccatcgctcaccacctttttgagcttggaaaagtttcctaaatctatgagttttcattttctcatcaggaaatacataattataggttttttgggaaattaaaacagatgttgcgtgcagagctcctagcacaatgcttggcacaatacgtattctcatcctctctctggcatcccttgactaagctgaatctcctaattctggaaccagagctgaataattctgcacaactatcctggggtatgtttacaggttcacatctgccttttgcctttccatctgcgccttgcctgagccattatgcaaagggaaaatttacctcttttccagcagagattctgacagcccagacttgctttctgattgcaaaggcagctgcttctcttgcctcctaagacctatgctcttatgcctgataaagtcatttttttaccttggtcactgggtgcacagagtcctttgtgccacacaaaggagtaatcctgcttaattctgtagaggtagttggaggcaggagagaggtcttttcaaatgcctgtcacactgcctcccttgaggaagactggaatccaaaacagtcaggccaaagcaggtggaaccaggaaggaaattcgctggtctttcctttctctaccagtgcctagctactgttggcaaagaagttcttactttggaatggcttatccataattattaataaagccaattttaaaatgccccatgaagtgcttagaaacaatgcctgcttgggcaactattttaaatattcgatcattggaacttgcccagaaatgggggcagacacaaaggtttttaaatataaataaataaagaatgagtgtgccgaggtcattgtactcccagaagaaaattactttcaaattacaactacataaaggaaataattgaaaagattaatcacactaaaataattggtctattttacaagtaatttggagcaatactcagtcattgacatcaatgtctggtagtaaaatagtaatgaatttcattctctaactaatgtatttattttattaatggtaataaatggtgttgttaccgcttataaatatttcataacttttaattcattaaaatgttcaatgaatttccaaaagtatttattagttttacatcatccttagtattcaatgtgcaattgccactctgcctgggtaattaaaaatattattgttttgggtaatgggactccctttgaatgtgaaggattaggctccagttattaatgagacggatgctccagctggtgatggggaaggggcttgggaagatgttttctctttaggtcgctaagagctctctggaatcgttccttaaaaaaaatgtggctgtgaagcaaacagggtggacccagataaattaattccagatgtgatcagagaaatgtcactttagacattggttccagttcaccacctgtcccacaccatctccgtcttcctgaaacaactgacagcaggattcaaactttccaacctcacctctatctctgttttattctccaacattagaggtcataaggagtgaaatggccaaaaagatgcaacagaaagaaaagcaagggatacagcatcatggacagtggaaagaagatataggacttggagaagaaaaacgtggacttgaatcctgagtcatttgggtgctacatgtccattacatcctgtggtaccagataattcacgtgcgaaatgaagacagtgacacctatccctgggtccatgtgaggattaaatgggatactgtgtgcctcacctgacacagtgcctggaacctagtggaaaatcaaactgggttagctctaccattccctgtgtccaaattgcagatcatggtattgttggcccagtggccttggcggctcttcattaactaacaattgatacaaacaattggtatgagtcatcaagaaaaactggaccaacagtgaactagtacaactcaggatcggtgaagtgaaatggcatcccctggaagaaggactagatgactcagctctcagcaccttaccctgtaggtctgagattcagctcactgtagtacttccagagcctctccatacaggaggctaaaggcatttggctatggacaggttgagaggtaccaacaggtgggttggggtaaagtggggccagcactcacacttagatgtttgcacctgcaggatgtgtagcaatgctcccaaagcatgcaaacccaaagaatcagtgtggctcatctttcaagagcttcagttttaccaaaagattggagtggaggaatattttttaatttaaactagcatggctatgtattgagttccaatgcaaactgcacgcaaatgttaagataaagcatcgaagaccttccctgctcatagtgattacccacactctgagtggtggctttactcttctttgccatttgggacacatcagaggggacaatagtaaggcatcactccagggtggacagaggaacatgaggaggaggtgcagccaggcctgggatcaccagctggagaggagagccagggagtagtgtgtcttctcagtgcaagccattggcaggtgcaacagtgggcaggatcctgaggtgacaccagagactagcagggggtccaatctcccaaatcaggcagagaagtgctcagtttctaaactgacgtaccaagtcagaaccaaacccaccaaacattagatataaaagtctcctgtgattggcctaaagtatcataaatgtccccaaggacagaattgatctgttgatttgttttgtttgtttggtggggtagggtggggaagggtgaggtggggagaggtaagcaaggactgaacctttagctgaagatcctggagacattttacttcctccctacccagacccctggacagagctcctcacaccaggatctgtgggaagctcacgctgaagtcttccagagtgaagggctttgtgcagggagtgagggagccttttgctagccgaggggcatagcctaggagtaccagaaagtgtactgctgggatttgatgatggttctctttttattctggttattttaaagttctggcattttctgtcttcaagttatgctgagagcacggtttttgtggaactttattttgcccttctggttgagatttgtttggggaggaaacattggcagacagttgctgggcagcggcccagaaggcccctcaatgcacaatttgcaaaccatagagcaaatggtctcggagatccctccttccctcagctccaacattatggagttctatgatcagcatttgggtggatataaagtctttcagcttttgctgcttctgcttcttcctttagctcttagccagcatttcgtatctacaaaacgattaacaaacattaactaattccccccattaatcatttatatcactggtagctcagagtcttatcatttccttcaagaacatttccttcaagacaggtgcaatatcctgtctggatcccaagtctcacgtctaggggatgatgggccaacatggcagccctggatcctcctgagctcacaggggaagtgggccagaaggtgggcacgggctctgtgaggctacaaccccactaggatgcctttctgctctaattaacaggaagggccagccacatggccagccaatggtagctaagaggcaataagctttaattagaagcttcttcctggaaactcacatggtcataataagtctgtggtcttaaaaggcccagagaggttgaatgcctcaactctcttttgcttttatgagctgatcctttcaatcgtttgtgaaatttaaatataatggaaacattggctctggacaagggccctgattatctcctccttgctacagggacgggcagcccaagtgtaaggtcaggaaggcagcctgttttcttcccatcctaggctgtctgtaagatttatgattcagaaacacaccacacgtgtgtgaataagctgccatggctgggaccaaccacagaactctcccttagagggggccagtttgtctcggggaggactagacagggaacaagccctctgcacaccactacccagagatccaggagaacaagtgaatagctcaaagcctctgtcctgaggacttgggcttatgagtgtatgaaggtggggtgcaaaatttcttgaactacatgatttgaattagaagagaaagcagaaagtgacaggaagaagtggtctctgttttcctccttgtcttaccatcacaggatcgatgtctttctttcttgttagtgcacggacacaaactcatgctcgctccctgcacactctctctccccaagagatccactgtgcacgtgtgtcaactaatgcacgagggctgtcttcttgtccatcccctgccattcttccactgatgtggcctttttctccattctattcttcctgttccttatctgtggctgtatgtaatgcaaaagcaggtgctcgactcagaaccatatcatttatttattccgtgtgatcataaataaataaatgcagacagatcattttccatctcaactgtttggcagctcatggacagccttcccctgcatctccccagcctcagcctcttctgtgtgcctctccacactccggatatctttgtctttttgcttgtctattaattcattctcacttctcgactttcttcctttccttttgtgaagggaagaaacctgggccgtggaattgcctgtctgatccatgtgtccagctccgtcatcagtgaagcctgctgtgctcttgctccaggcacaggcctgaggctgtatatccatggacaaggtggctgaaatggttggatcggctacactggagcccagctccagggcatacacagatggaatattcttctcttttcatccttactctaagcaaagatcctctgatgatctctcttccctttccccttctgctatttctcctccttttccttcaagtgcctgtcattttctcattaggagaccaacacacacacacacacacacacacacaaatatgcacgtgtgcacacacacacaaccagcaaggaggcatttgaatgtggtgatcctaaagaggacctcaggggcaaggctgaggtctttaattagagattgaggtcttatccaaggctgaggtcttccctagtgccagtcacatggcaaaagcaaggctctaggtagataagaaggtccagcattttcctgtgagtgtcaagaagttacattggagctaagattgcagtctctgcatgggaagacactggaaagcagggtcttgagaagagtcttttctcttctggggtcagcaaagcacagagccttaaattcatggcgagtgctggcggttttttgatgtatgtttgtttatttgttttgcccttgtcttttcctagtcttcagtaaaatcatattgaacgttccagcttatcttggttgtactcccagagttttgactaggcttttgccagggttttaaagggtttaaatatcacccctgagaacagatggatgatggcagtagtgatccatgggatactccaaacaaatgccaagtctcagaaaaaggaggaggaagacagggaagaaaagagagagaaagggagaaaaaggctatgaggtcttaccacttcccactctatgaagttctccttttgtgcccaacctggaagttctgagcttgtattaaggaaagtgaaatttccctacctggtatattccctatcagacatataaactggtctgtccatttccccaccacctggtaatttgattttgcaacaagaagccctacttctagaaccaaggcaggagactttactagagaattcaaattctttggatttttgaaaattttatttgcatactcatgttattatattacctgttgcaacatcaccagaaattccgctgacgtatgaggggccactgtctctcatcactgagtgttgcttttcagagatgaaaaaaattggaaaggaagtcacacagccaccatttgacaagttattttgtggggtgtagaattcctcccactgtaccaccatcccagcccttggttctggcacacaggcaatctcattccatatgatatgaggagcagcccagtgttctgtctgcaaagctctggcaagctcaagcaaggcttcccattacccaggtgggtcatccatgtgccacagcctatttgactttagcgtctgttatttttccctcctgctaaacactaagccatcccctttatctccacatccctggtgtttggctcaaagcctgggacaaaatggaggctccatgaatttttgtaaaatgttgaaagagtgaatgaaaaagtgagtcaaaatggtgcggcacgggaaactataaacacaaagctgagtaggaaattgagatcagtagctagaaaatgtaaataaggcaaatatattaatatttcagatgatttcagagattcatttaatcactttacataggcattcaactttgtaattataggcaaagacaaataagccaagtagcataagcttagattctagattctcccctgccaatataataacagcaatgacaataataacaataataataaattgcaagaatgggcccttcaatacacaacatctagaaactccttccctaggtcccgagcactgccagcactactcagggagctgatcaattatgtacgcaccccagcatgagttgcttaaggtgtaaccttgccactgctctgaggatcttacaatggaacagaagaatttgctatatcctgtcacctctcttgccccctggggtttcagttgactatacaattttgtactgttgaaactcacaagagtcatataatttaacatctggaaaggatctaaaggatttctttgtcttccttcctccctcattttacagattagcagattgaatcccaaagacattatggttctacagctaccaagtggccaagtcatgagtttttaacctcctattctgttgtttctttgactgctccctgcccttcttaatcttgaaaatattagaaaatgactttaaagtctctgtgtttatgtttctcaatacactggaacctttgtcccgaatccttaccctccagcacagagcctggcacacactggttgctcagtcaccctccagcacagagcctggcacatactggatgcacacactgaaataaatggaacacatggcatccagataaattattaaatggataataggcacactagaaccttatatctcggcttgtattttcaaaaagaggacggcccaagctcagcccagggaagcggcgtgtttgaaaagagagtaatgacgggaggaagaaaagccagaccagctggaatatgaaagaactgaccaattggaaaggaccttcaggagcatatagagaatataaatcttacattctatatgcaaaaattaaaaattaaacttagctctttggaaaacccatttccgtcaatggcaaacagcttaatctaactaatttagagtaaactctgacacttggcaattttttcctcccttttggatagataatcagataattcagaattgttcttctctcattctccatatcattcctctgaagtgtaagtaaacatgggaaggcttctgtatcatcctagtattggaagagccatctactcccttctccactgagactcactccatgttggtctctggtcatgggcccagcctgagtgtgactgaaggagtccttgctggcaggtcattaggtccacacagatcactctgtctccatccacaggacctccaggtctgcccacaccctctcgaccacctctgggcccctctcagggcgacactgagaccctcaaagctctcctatgcttctctgggttcccaggccctatctgccaagggctccccactgccctcctcaactcccctgactaccaaagcggtccagtgctaacttggggcacacaggtcatctggttcccaagctccctcaacctttctggtaaagtctcaggtagggaatgcacccaccttgttgctcctgcagggcccctctcatgctctccttgtctatttctctctgctcccagcccacagggtctgttccacatcactgcacattctgcctcactctgtgacttttgactacaaatctaggttttggggcctatcaattcttggttccagatattcaaagtttagctttttagactcaaggatgtaatttcactctcaaatagtccatatcttactgctaaaaatctgtattttcaagtgtatctgccctccccaacccaaagtagtgtgcagaaaaagcactagcggctctctaaatggagggaaatgaaggattgggtctgcaaagctcaggaaaaagaaacctcaggcgatgttgcaaagcatcaccatattttgagtcgtaattgtcataataatgagctcattgtagtgccacatccccagactctagttgtccagctgtctctagctaaaataatcaccagagagaggtatcagtgcccttttataaaggtctttatggagaaaatttccatgacagttatgatgggagataaagaactcaaaatattttaaaattctgatgttccattaaatacccaaccctttttggtatcgattgtagtcctgagtcagattcagagcttgtagaactctaggtaaatcctttagttttacaccaaattatctcctggcaaaagatgatgactgaagacaggatgcagagtgtgttctgattcatttttggaaagcaccacttgtgtctttttcctgcacaaggtccccatcatctgtagaataaagtttggagaccttggagctggaccctctttctctggccccaacctgcctgcccagcctctaagtccaacaactgggctcaaccagatccataacctgtcctctgaatgggccagagatggccatcaccctgccctaatcccatctgttcatcaagcaccatcacaaatctcatttcatctccctgaggcatctgtgagtgcttcctatgtttaaactgcacatttggcactaactggccttaaattacctgctgctcatgacttctcatgtaaaacaattttattttaagtaaaagtctatgttttgggcagagtctagcaactcttgcttcagccaacacacatgagaatgtgttcctgctaatctagatggtaaattccctgaggacagcacacctcggtgaaaaaaattttggagccacaaacagcatccaccgaactcaacctctctgagcattggtatttctcattgcaaaataggaatcattataatgccaaccttatagggatgggtttagactcagtgagacaacctatgtaacacactggcacaagaaatgttcaaaacaagctaattctcttccttctttcccatcaagttctctatttcctcctcttcctcttctcagccttcattcaccaaaatgggtcctgctaactcacatgatggtacaatgctcaaaataatatgtgcatcataaagatgggctcagtgttggatgatgaatggatgaattaattaataagactaaatgaaatgtaaggattgctccgtcacccacgcctgttccctgttccacatttggtctctacaaggatggcctcacccagccttgggaagcctcctgaccactgtctggagccctgactcttctttggccatttttctaagaaacgcttagcaaggaccctacactgggcttcagttttcttgatagtgaaatccaggatgtatgtaaggaaggatagttggctccatgctcaaggatggtgtgtccttcagaaggaactggcaggatttctatcagaaccccattcccttctgctgcaagtgtgccagggtcttctggcctttctaagcagtgacatgaagtccatggtgagctgacttggttagctggtccttccccagctccacctccgacccatgatgcagagaagtcaccatagcaactcaccatactccatttccccttccaggaggggacagagaaacaacagcaaccaaagcctctcagccattccaggtgttatcatgacccaagctgggcatttattttctgggtctgaaaacaccaggtatctgccgtagaacttgggtggctgtcttagacacatgtatctgaatagcctccctttcgttaatctctaaccatgaaggattctaattcaatgtagaatattagtacagtaatattcagattttccccattttgaatctgtgtttatagcccataataataaggaactgtgaggttgggtgacactttaaggacttagatttagtttggtgagagcattgaagggttttgtgatctcactcccaaatgggaggaagaaagaagtctcctagaaaaggggatgccacctcatgcccatgttacttcagtttccagctatagtattattatatattctctcaatgctctcaaacagaatgaaatctgggttcctcgatgtgtttttaataacttttctgaagagatggctgagtctgaattgttgactcaaattgtatcagctttccaagaatcttgctttcagaggtgagaatgatgaattaaagagttacttacttggatttttaaaatgtgtccatcactgaggcccctgggcttgtgtacaaagattaaaaggtactattcccccaggaagatagactgaatcacctgtatacatgccaagacaactacagtctaggtagccatacagtcctggcctacagatccagaagtggtggtactccagcaagctcacccagctagaagacatgtctcagtagaagcagagctctcatgagggtgtgagagatgaggccaggtgatttctacctacactttcaagtcaggagacagacctctctggggctgagggctgtgagctcagaaaggcgccactccatggagaaggctatgcctccagttccctagatatgctgttatccaagaaacagcccagctgtcatcggtgaaggcccctaggaagaaggaagccaaagtgggttctgtggttccagagaagagacattcccagagccattgatttatgttagtgcataccccaggctctgcctgagaagagaagagatccctgaaacccacattcttagaaaaaggttctagatagccattatgagagagaaactggggcttgcccacttttactgaggactcctggagagaggaagaggcaagtacaaagggaagggaaggaaaatggaaagggaaaagcagccaggcaagtcatggatgttgatgaaaacattcccagaaacatcttccccttccttccacacacaatggtggtgatgtgatggaaatactagatggggagttactgttgtagcaacccatgtaaatgggaaccaatggaagagaaattatatatgccttgcatttcattcaatgttttttctgtttgtttgtttgttcatttgtttgtttgggagtggggattgtacctgctatttgctggcatcaaactaggtgccgggcaatataaatatgaaggcaattaaaccaagttttctggccttaaagagctcagtacagtggataagacagataaagaagggactacaatatagtgaggtgaatgagacgcagtgctgtggaaatgggggaggatgcagtgactgtgtgaaggatgataatacaacaaagccacagagtgagtgcagaacagaagagcacagacattctactcatctcctgggatccatccagctccatgacacctctccaaactctccttccctctccccaggagcactgatagattcccgtaactgtggacacacccctcttaggagggtctttccacaccttgtcacacatttaaccctctgcctccttctaatatactgtcagctccttgtatgcaagaaccatgttttcttcatgtttgcctctttagcacctagaatattgaagctgaatactatgtgccagattgtgagttgctagtgtttgttggcaggaaagaaagaaggaaggaaggaaaaagagaaggaaggaaatgaatttctccaacttccagaacttcttcccattacctcccgtccttctcctgtatttggctccttttttgttccatccagtaactccttctttccccctgttctcttcgattcttcctgcccaccacccatcaatccattccggagccctccctttcactttccatcctttgtcttcctttctctgtttctcctccaggtccttccctttttccacttcttgtctgaccccctaagcctttgtgtcctttctccatccttctctccctaatttcccattacttggggcagggtcagaggtctgctatggctcatgaggaacaatgaagtgatgaaaaaggatgggctaaagattatttgtttcaaagacagtcgaaggaatggtgacagctttcaaatggggcataaaccaagttaagccttcagtcaataaacaaagaaccaggacctccaaccagatagcggttgtagatataggccacaatatacaaggatcacgtggccaaccagttttgagggtttccagcccaaagcagaagtcctgggagagcctgtgccccactgaaaaagaccctacatggtgaccccaaattgcagaccccacagggatcgcctgtcccagccttacaacttgggaagccctagcaccagagagattaagtgacttacccaaggttacatagcaagtcacagctgagtcagaaccacagctcagcttctccactgctggcccagtgttttcccactataacgcattgcctgtagctccagcaaatgcatttcctacgcgccaggattgatgcagccagcatacagggagtcattcttcctgctgagaaatgcatccagttatggggaggaaggtgacagctgtttaatagcagctctgtgggatggttctggacttggaatgtggaatattatctcctgctaatgcattagcagagacgaggggaaacagaatgtaattacccaaacggctgtttttcccggatactaaaatgaattctcccaccctggtgaataatgtggacggtctttaacaattggtttatgccccatctgaaagctgtcaccactcctaatagcacagggacctgtcttgccagtcaggggtattgatttgagactgcgtcggcgatctgctcgtggattcatcagcttcctgagagagacgccccaaaaaggaagatccagggggactttgctgctggacttctgacagcatggcctcggggcctccctcaaatatgcccatgcttctctgcatctctgcatctctgcatctagctgagccctagcagtttatgtggtttcaggcccatgaccaggggtggtgggagggtccaatccaaagtgaagatttagagaaataccccattcttaggagaacccagaacaagtaagcttctgaccactcatctttgcacaaacctcatagataaataccaactagaaagcacataaattaagtataattaattcatctcatcaacctagaaataacttctcttctaaatgtctgtgggcttttattttttaccaccattatggcccttatgcttcaccacaattcctagttatttgtgctcctgtcatatctgccctaagactgcaactctttgaggataagagtccatgaatcatttctgtattctcacatcacctaacacctaccacagagctgtacacgggaaagatgcccaataaatcaaatctcaacatgaagtcattgacaaacacatggcttcagaggaaagaatccatcgtgggcaggacgagccttgtgtcaggagctctgggcaatgtgctatctctgcacttcctgtctccagaggtcagaaggctacacagaggctagaccagggacaggagaggattagctgaccaagggcaggacagcagtgcattatccaaaaagaaaggaaatggagtccactcagactaaataagacctgggacccagaagcctcactcatggctgtgaagactcttcccagagagggaagggccaggactgggaaggccaactgtgccagaaaagccatgaatcatggcttgcaatcttggcccttaggaagaaggaaaccaaagtgggttctgtggtcccagagaagagacattctcagagccattgatttattttagtgcacacctcaggctctgcctgagaagaagagagatccctgagacccacattcttagaaaaaggttctagatagccattatgagagggaaactgaggcctgcccacttctactgagtacccctggagagaggaacagctttcagactgtggaaacgtcatggtctggatgtgagaaggaaattggaatgcaggtcaggtcttcttcttctcagtgatgaggaagcatctggacaaagcccaaaaagtcttaggcaccaccaaagggccgtgctgcttaactgtgttaggtggaattatcttcaagacagagacaggagggaagcaggcagcagaccaccacccagctaacaagactgccagcccgggaacaagctgcatggtgctggccgccttctgggagatgagtggctgaagcagcccattcaaaggctttgggagcctttatgaatcgaatctctggaagtccagctagagtgtctattgatcccaaagtcaccttcaagtggaacagccataaattaccagtcagcttttattatgtgagagattttcaaattctaagcctgactttctccttttttattatcctaatgaaataccatgacttggcccagtcttaagaaagcacccagtgaagaaggaacaggatttctgagctaatggactcaagtcctcactgagaagtcctggacaccaaccctgccaggaaccctcctctgtgtgggagacaatctggaagccaaatcacacagatttgatggaacttaaagtgggtggaggtgtggacccagaagtatggaggagacctgggccaccctgaataataccctcttcaagggaggggcattggccgcaatgcaaaccttgactccatccaggaatgacactagtcccagctggtttgtgtgtggatgctgcagtgttagtttttctaaaggctcctttacattctggtttgggtcatccttttagatatacctagaagattctcttttttagtttttttttttaattaccatagcaagaacacttcacatgagatctaccttcttaacaattgttgtaatgcacaacacggtatttttaactataggcataatgttgtacagctgatctctagatatacctagaatattcttaattgtacaactcttagtggaaaaatcctgtgctgaaccatttattactccccaaacatttattaatcatttacgaacgtatataatagggaattgttggtcctcacagagctggtaaggtagtaaggaggaaggatctatgacaactcattataaggaaattaagtaccctcatgggggaagctgtggaagcagagaagtgagcatgtgattccaaatgggagaaaatatatcagtgcctgcccctcactgagaccacagtttattttctggaggtgcagatgagatgctgtacagaaaggtgggcatttgcaggcagagtaaatccatgtccaagtagaactggcaaacaatcaaattccctgacactggagcaaacttaagattgacaagcctcctctacagcacttgggagaacttgctgtcaatcagtctgcttcctgggggccacatgctgggaaacttttgttcttatttggagacaaacaagatggagagccttagactgaaccataggcccaatcactaacactctgtgtgaggcttaaatatttatgtgagattttctccatatttacttctacctgatgttttctccatctttacttttcagctaaggccagaacatttattaaaaattacacaatttgatcacctttttcagtcatcattcagagatttaaatttctaaataaagaaggtaaaatatcttaagaggacagcattgccttttccaaagagtggaaggcctgtcttggttcagttattgttttaatacatttgcagattttcttgcatgaaatgttcatgacacacaaagcaactttataggtactcctgacaaactcagtaccatattggttatggactctggttctgcaagctgacgttctgggctcgagtctcctttctgctgtttaccatctgtgaaaacttggtcaagtcttttgcttcttctcttagcctcttgttaatctgtaaaatagtggaccaaatgggatattgcacattatgtttatcaaagtgattagtacacagggagattttacttttgacccaggaaagggccaagccagtgagatattattaagcatctctgaaatcgagagtatagtttttgagatacaacctcatctaccatatgcaagggaataatcctttcctcctacccctccaggaagatcatagcttagttcagggcccctacctcctgcaaggtcagcctgcagattctgcagggggagcattgacatgaaagagatgctaggtcaaatcccacctggagcttggcatttgacatgggagaccaggaatattccaatggacagacaggtgggggagatggggcctcaggtttgccacagcacccccactatgaccaggaggacagaatgagaattaactctggctgtggtttgaccctaaataacaaaggcatctgccgtgaaagtttgccatgactgctgagatttcaggaataatataactggcctttctagaagctagaagcggtggtatgatgtgctgtgtcaaggaataaagagcccacttctccctggaagagtcacagatgtcttcaaagatcagcgtgagctgagccctgccagcgggggagaaaattgggacagtgagatgtgcagggtattccagatgccaggacagtgatagtggtcatgaggaggagatgagggcaaagaactaactagtgtctgcattgtcaccactaatcattgctgactcatatttagtcctagtgaaggaccaagctttgcattcagcatttaaatgggttagctcgtattcctcactataacccatgtggtagctcatcccaattttggagacagagaacctaaaactcagaggcgttcgttatagctgatatgtaagagcagaagtgagtaccatggcctggttgaatcttcgcactcagttggatgggaaaaagcctgtggtttactcacaaactacctgtgagtagtttgttgtggctgaagccccagagggtgggacttgggggtctctgaagatgtggagcagtcatgggctggatggggaagcttcatttactgagggtttagctcatgcccaggaacctggagaattctttaaccctggctgaactcaggtgtctccttctctgtccaagacagctcagaataaacagcaccctgcagctgcacaagagccctgctgtgtgcagggcccagatggcacgcttgattttctttatttatttggatgtcattttcagtgtgattgagtgattccaccaccccagtgggtctgctcagtctcccatcccaaaatcaggcaggagtggaacaagtttgaggtttctgaaagatacttatttattaattgggccaactctgactaagcagcttttactaaaatctagaaccagaggcagcaaagtgcggagaagggtacactcagggcattccattgtactgtagtgagaatattacttaattttctaacagtttcttccctgggacttttttttttccaaattaaatctgatgtggagaaggagtatagcatagaggttaagaatgtgggttaagagtcagactgcctgaattcaaatccaggtaccaccctcactagccgtgtaagctatagagtaagttatgtaacctctctgagcctcattttcctcatctgcaaaaaagaagttaataatactatttactcttaggattttaaggagataaaatgagttaatacttgcaaaatgtcagcatacaacctggcacatatatagtcctcaggaaacgtcagctattattgctctgcggaacagacacaatcagaagggcccaggctgcatcaggacagaggggccttcagattccacccatgctcccatgcaggctccttggacctcgaggggccttgggcaggtgtctaacaagtgcctcttcaggagggagccttgattttaccatttgccaatttctgtagtgtaaatattcccatgatggctgattataagataccactgtgaggtctccagatgtggaattgggaagagatgcacacaattggctccagcgtgctactctgggagcctaggtggaagccagagagtcttaggtgtccttgtcagctctggctttgtatatcctaactcagggtagcctaaacattggagttaagctccccaccaatgtttggcagatgtgaggaaatggacagagtgtggagcaagcagaaaagagtttggagagttcagggtgttaggttttaatgcctgacctaaaaggcagcacttctgacagttcagtgacttttaattagatgagatcgaatcagcagaactgcttcctgtagctaaaagtctttcccttccagtgcagccattcagttactgctagggcccattgggcaacacgcctcagccgagggatgggatagtggcataaggacatgcattgcagagaccttcaaggacaagtggtgtgtgtgtgtgtgtgtctgtgtgtggtgggtgtgtatgtggtgtgtgtgttagcagggagcataggccaggatggactgaaagtcttgggcttagaaactcaggaattaccctcgtagaaagtgacctgagaaccagagaaattacataaaaacagcactggagtgggaatgtggggacctgggttttaggcccagtgctgcatgactttgttttcccagctgaaaataggagaatcaggatgcccaccatgccttcttcacaggggtgttgtagaatcaaaagacatctcatctgtgaatgcaccacacaaatggaagaggttaatctctactcaactgtgaagtagctaaatgctcatgagtcggccaaacaccttggaaaccaatcagttgctagggaaggtatcaggtatccattcttgtcacaaagaaaagtgggctggccgggcgtagtggctcacgcctataatcccagcactttgggaggccgagacaggtggatcacgaggtcaggagactgagaccatcctggctaacacagtgaaaccccgtctctactaaaaatacaaaaaattagccaggcgcggtggcaggcacctgtagtcctagctacttgggaggctgaggcaggagaatggtgtgaacctgggaggtggagcttgcagtgagccaaggtcgtgccactgcactccagcctgggtgacagagcgagactccatctcaaaaaaaaaaaaaaaaagaaaaagaaaagtgggcatgtggtaagagtagtcatggcctgggactggaaccagaaagctacatgtgccaggaaagcagctcttcatcttgctcctcaaaagaggtgagagcatctcttaggtatcatgccaaagcctctgggttttagcttctctctctctctctctctctctctctaaaactgggacattgagaagaaggatgaagaaggatggtctccggtgcacgatgccatggctcccattgggtgctgctctgctctcctgccttctctgatgagcatggcccagaagggctgccttggccccagatccaccccaggatcattcagctcaaccctcacagacacccagcactatcccagtcttgaattctgaagaaaggaatctgatgggcccagatctggcttttgagcaaggccacatgcatcttaggttgttggccagcttgtgaaagcgcttcccttctatcacagccaggaaggagtcacgcagcgcagagaccacagggccacctaagacagggaagactctgtgaggagtcaggacaggaaacagccacagttggcctctctggaacatcctgtgctcctcagacacttctacagtcttttcttagccccttaaagacaaagaaatgaaattctgaaagaccttatggccagcacatgagactacactgaaggtcatacaaaagctataaaagtcagtgaaaggctggtctcaggtgtttgagctgccaagtgacagaaatgccccagcctcaggctctcttgtgcttaaggaccaaaggctgtcctttgttaaaagtgtcagctatgtccatttatcttcctacctttgagtctcaacatcctaatcaggcaaaacaaagtaccaaggttttccttatgggatgtccatgaagaattcagcagagtctgaatgcattaggttgaatcatgtgaaactgccacttttatgtgcccagaacagtacaatgtcaccagtttcatctggttcaacctaataggaagccttcaataaatgctttttttttttttagatcctcacttcatcatgaccttctccactagaaaatattgaaacctcaacacactgcctttgggtcatttacagttcaacacaagtgtgtaatgaacaaaacacctctccctggtgtacagacaggagcaggctttagctccaacaccaccttgtaaattccctgccctctgctctctagagatggaggtttgctgtgcatggagccagacccagactcggcaaagcaataaaagctctgtgttctcaggttggaaaattccagagatgagtcttctgtttaatcatgtcatttttttgctctcttccctgaaaattggagtaattgcaaaatgtaaatacacaaaaagtgaaaaaaattggtgattgattgataggaaggaataatgcatcaagctcattatcttcccctggagtagcacacagccagacctgaagctcttctaagcacaggcagggcctgatggaggacatggggccacaagaacagatgggccagtttactgatctgggtggtgccagatgatccattgagtagagggtctgcaaatatctcaagcattgattttaggttttacaatagtgatgttgtccccaggagcaatttgaggaggttcagaatcttgcagcctccagctgcatgactcctaaacaataatttctaatcttgtagctagtctgttagtcctacaaaggcagtctggtccccaggcaagaaggaggtttgttttgggaaagggctgttactgtctttgtttcaaagttaaactacaaactgagttcttcccgaagttagtttctcctgcacccaggaatgaacaatgacagcttgtaggttagaagcaaaatggaatcaggtcagatctctttcactgtcataattttatcagttatgatttttgcaaaggcagtttcactcccatccctcaaccctttctggactctgcccacttcccacaaaccctcttattcctcactaccccacagcctctatcttgtggcctctcctgcctctctaccactacagcctaggtgtcttgggacaattcctctgcagatggatctggaagtgcctgctcactgaccactgattgatcggtcaacgtcacaatatcacataaccctctctggacctctcttttcccagataattggatgttgcctgtctaaaagacctctgagcctgagattctgtcctctgtatctttgctttagcatactcaccacagccacaaggcaggcatggaacattctgggcgtgatgtaggagagcaaggttggggagggcctcaagccgtggcctacacagggcacttctttcgtgaccacgtggccctagcagctggagaccagcctgcttggctccggcaagtattacaggccccacacagattttaaaggcatttctgcctgtcctctctacatacatttccacaaccagtaacagtaataaatctatgccactcctgacagtttacaaagggctttcacatatacatctcatgtgctcttccccacaatctttattgtcaccagtttagcagtgagggtgagggtgcagcacagatgtgaagtgatgtgactaatcggtagcacaacttgaagcggagcacagatggccgattcctaccccagtggcctctccaggatacagcatctccctcctccaagatggtcatcatctcctactccttatgacggggcagctggaagaagagagagtggctgccagggctagggctgatgataggattggtttcactgtggccagagctgagaaggttctgcatacctagagctgcagggacccccaaacaggagagtcctgggatcttaaagccagcattctgctcttcacctgtctcagccccagttaagtgccacttctctctctggtgcttcttcttccaactagggtactctgcttaggagtctgggtctgcctctcccaccctaccaccagcctcccatggagttaactgaattatacctggcccacattagcctctccagccttacctcaagactttgcagctgcaatcatcaccataaatcagcaagtctttccatgtgtttgatcagatttctcaaactgagaatctgattgctccagtctatctcttaaggcggaaccacacaagtcacaggtgtggccagtctagtaattggttgcccgtggctcgatctgtggtggctggagtgggcatggtctggttcagaagtggcccccaggatgcaggaactctgagcagaggactggtccctggacaatgaagggaggaggagtgagcatgcagttaacgcttttgtctgggatgcctcccctgtgtcattatcgggtgatccctgctgacctgtcatggcccagcccaagtgaagcacaaaggcttcactgctttgtgaagccttcagggagaatgagccagtcctctctctaagcttccatacatctctcctcagtttcagatatgtcttcacccccacaaaaatataagatcccaaaagaacagaagtatttttcatctatctttaataactctatatgttaattcaaaatagaagccacaatataactcagtgtttcccaacactgttgtggtgaaaacgtgtcccatgttcaaataggagcaatgaatgttgggtttttaaatgttgcccaaatttctccagtccagggtttctcagagcctttaatttgctaatgtacaatatgaatctccaagagtaaaatagaatatgcagccttcccaaacttattcccacaaaataatcttttcatgaagcaccaaaaacagttcccagaaccagtgtttttgcagaaaacagtttgggagatacacatgtagcagaaattccttagactcaggtgcaggcaagctatagttcaaatttggctctgcaaccttggacaagttgcttaacctctctgggcctgagtgtctttatctgttaaacaaagatgataatacctactcacagggttggtaggaggataaaatgacaaacagtgggtccagtgggacttgctcagtgactgcctgtgagcaggtgctccgtaaatggtcgctgctggtttcttgggactctgtcattactgagtttactctacagcaggtactcaggaggttctggttcagaagcacagcaccactgagaagcctagaaggcccctgagagccaacagaaactgagcaagaccagagccagtggcagctgtctctgtcccacagaggtggggcaggctgactcaggtgctcaggtcaatggaaggatcttcccaggatctccacatctgccagtcccctctccagatccaatggccatagggatcaccaaggggccactagcctttcactggccacaacaaatgtctggtggcccaaggctattctcatgcagcatgcagaataaaataatacagtcacttacaatggcccaattccttcacattcacaagattttctttgtggcttccatcttatcccttcaaccagtcccgatagacctcacatagaatgctctggagttatgtatcaggatagttctaatcccagaaaccctgtaggatagacaggaccgggattatttatgcccattttacacatacataaagtaagacttggaaagactaagccagttgcccaaaccttcaccctgagagcagcagtttatcagccctgcttgctagagatggttcttgctgattatccattgctctccaggctctgagctgcctccctctaccttgagtgggtaacattcctgtttcagtgattcctgccttgtgcaggctgaacttcccagccaggtgtctcctgaccagccctcactgtagccatggtgacaggacccagcaggtcctggttctactcatccagtttggagtcttccccacagtcgcactgtacattgcaggctgctcttccctgagcagggcacatcctaggtttggtgtgtaaaccacatctccatccttcttccagctgacagacatagctcctgcctatgagctgtcacctgtccactctgcacatccttcataccacctgcagggtgctcctccagagctggaaataatgaaaggggaggcctttggccagagcaagctgccctgatttttgcactagagtatttaaaacagcccaggtacagaggatccctgcttcctggaagcggagttgttttgtgtctagatgagcgtctctcttcagccattgccccctaccgccatgccaactgccttagcataatgcactctgatttccccactgtgactagcaatggactattaagccagtgttgccccacgaatctcagcctatgaggcagcaatcacaaacaagcagtttgaaatgactttcccctgatgaggctacaaacaaacagaggccaaaacccagcctgtggcctattgtcaagaacaccagtcagagcagggtcaagaacaaagtggcaggctgcaacacaggccagggaaaccactgcttcccagtaattaggacccagtgagcccatagaataaggcagactctactgtcttccctgagccgatggagagggcgaccctgcaacccctttcagctggagtggggactgagctagtaatgcagccaacattcatcaagacttactctgtgttaggcaccactaagaacttgatggacagtaattcatttgctcttcacaaaggccacatgaagaaggtactcttattatccccgttgtacattcgagaaactgagtcttaggataaaccacttcccaatcttacggagcaagtaggtgatggagccaacagttaaactcagacagcgtgtcgtcagagccactgaaaggtcctgattgaatctgggtccctttaatggagagtactcagtgaacactgataacataatagagcattgaattaggagtccgtccttacgatgggagctgtaaatagcagaatgtgagctgccttcagttctgcctcattccttctatgtgatctgcacaagaaccaaactgacttcatctctacctcacaggactattataaagattgaatttcataacatgtgtcaaagtgtttcttaaactatgatgcttaccatacgagctgtgagcatttgttgctttcctataaacaatcagtgtcctgccctcgtcctgctactcactagctaactgaaatggcccaactgaccttgtgaattggtatttctaagctttggctttttaaacatggaatgacactattgatacaaggccagcttctcacctcgcttcctaccaacctgtttgtccaagttgtagagccttaatgagctgagcccctgggtgccccgaggatgcacaaataccaaatgaacagaaagcatttattattatggtaattgtgctaagataccctctccagagagctgtgagcactttacagacacagttcattcattctcataagcagacccagatggaccaccctgggggacaatctggctgggtcgagtatgccaagtcagcctaggagagatggagcaacttgggctcactagggtaggggcagaatcctacaactcatgcattccacccctgcccagcctgacacagatcatgttgtctctgagaagaagcaactccttcagccctgttgtccttgaagaccagttctcagcctgtatcaagttgatgggaaaggttttaataagacacagcaaacccctacagctgtcccttgcagcaaaaccctcatggcagaggttcttaaggtgtagtcccagaaccagcaccaatgtaatttgcataattaaaaatgcaaattatcaagctctatcctagatctactgaatcggaaactccgggggtgttaagaagcatgactttgatgcatgctaaagtttgagaactactttcttagagtaaatcccagttatagttgcaaaggttatctgtgcctcctgaaaggcactttcttcagatggaaagagctagatcggcagctgcttatttactgagcagtcaatattcccaggctggagagtccccacctaatacatctctatcatttcattttactgcccaagtattccctgcatcttaggagtggatgggaccatacagccagttattttataattaaaaagaagtgaaaggacacagacttcccaaattctttgcttgatgacacaaagttggagctaaatctcccctatgtcctctatgaaagagaccaaggtctcaacggcagactgctcccagcagctcagagtatgagccctgccacttcctgaccattcacaccccaccccatccaaaccaaaggacggcatttagtggtcctgtgcagtgttcctccaagtgctcatggaaatgagttggttcacctcctccatcagcccagtagcccacctggaaaaccagattctaggcagaaagagggtgtcagagtttcagaggaatggccaggatctctctcctcaggcagggccagagaccccactcttagaatgttctaggagaagccctgaactggcagccaggagaccacggttctagttcctctctacctcttaccacccatgtgaccttgagccagttttctcatctataaatgggggtgacagttccatgtcatagagttgttttcagtattaactgaaatcatgtaccttgaactacaaaaaacggagagtgctatgcaaataaagatctttattattctgagtcgctgctctttaaagaagacaagtgaggtcaggaaagcagatggagaccacatctgaccatcgggtaaggatttatgcgtgaaactgtcccactgattggaatgaagacccaggaagcgtgctgcagagtgcatggcagctctggggactgcctggctggtcagctgtccgtgcttcattcttctcctcctcccagttcagagattctgacagatggacccaggaattgcttcctggttcagccagtgaaatggacgcagtgaataatctacagtttacccctgagccagtaaatccaaactcttctgcattgtgtcatgccgggatcacaataaatctggcataagacgggacataaaacatatcggtatttagttgatttgttaatttaactgtcaatggaaatcagatgttgagattcactgtgaaacgaagtagcaatttgtgcctctgtcagaaatatgggtctacagtgtgattcagaaacctcgccccagcctggtgggcatttcggggatgctggtggccctgagagatgccaacagcttggtggcccaggcctgggtaaggtctgtctccccatccccatggctgtccacacttggaccagccctgattctgcaggatgctgtagggagtgggtcaggggtgtgaatgagctgtggatctctgaaaataaagcagactgcattcaattggtaccttcctgtggatctttttttcccctctgaaaatagacgcaatcctcaccctgcctgcttcctggattgattgagagaaactaatgagatagtggacatgaaagggcttggaagagttttgtgaatagaaatacaggtcatgtattggaatagaaacagggtgaattggggtcgtcagaatgtaagcatcagcctaggaaggaaaaagaaggactgactcactcatgcttcttttagagaaatttacttcctttttttgattgtaaaagttatatatgtccattataggacacagaaattcagaaaggtttagaaaagagagctcaaagcattcataatcctctcccttagagataactatggttaacaatttgacatacattccttctagttttcctttctgtgtatataaatggattttgctatgctgttccaacagtcttagatacaggtgcattgggcttgtttggttggctggttggttttctttttagttaatttattatgaaaattttctcatgttaataagggttcttcaaaaacacccttgtgtgacacaggggtacgagcttttattactgtttccctgtctgtggggatgttgtttctttgtttttgctttcatggtattataatctgctatgagtttttttagatctaagcgtctgataactctatttcctcaaggaagtttcctaaaagtggaaccttggggttcaaaggtcttaaatacaaagtttttaaggttcttaaaacatactgccaaacttttctagaaaagttctcccagttcaccttctcaccagcagtatgtaagagtccctaactcactacatccttgctaggactgagtattatttttatttatttatttatttatttatttatttatttatttatttaaattaagacagggtctcacactcagtcacccaggctggattgcagtgctgagatcacaactcactacaggctcgaccttctgaggagaactcccaggctcaggtgatcctcccacctcagcctcccaggtagctaggactacagacgtgtgccaccatgcccagctaatttttttgtatttttagtagagacaaggttttactatgttgcccaggctggtctcaaactcctaggcacaagacatctgcctgcctaggacttccaaagtgctgggattacagatgtgagccactgcgcccggcctgggtattattttcaagtctttgctaatttgatgaagctattttgtgcaaaagctatttcagtttctgccattaaaagtaaaaataatggcaaaaaccaaaatagcttttgcaccaacctaataaaatgtttgaatctgaccatcacttcacacagctcatactaaagtcacacagacaagtcactattccctgagcatggcatcatctgttcctggagttcccttatcttttctcttttgtttagaattcttacccactctttgaggataactcaagtgttatctctttcctagagccttcttttgccccctggctggacactccttctctgtgtgcctatcattcagacatcccagttatctatttctgagcaacaaatactccagagcatagtagcaaaaacaacaaccattttatcatttttcacaattgtgtgggacaagaatttgggcaggtaactttttcatgccacatggcattgacaggtcatgcattggattcagctggcagatcaagaggtgtgtgggctccaggatggctttgcttgcatgtctgctgccttgaaaatgatggcaggagggctgagctcaactgggactatcgccagagtgcctacacctgacctctctagcatggtagccttgagggagtcaaacttcttacatgcatgccccaggctccaaggccagatgtatccatgaccaaggaggacgctgcacagtctttatgatctagcctcaaaagttatgtggtggcttccatcatatgctgttagtccaagcagtcatgagcctgcccgactcatgagaagaataccaaagtctccatctctccatagtcctctcgagaggatttttaaagaatttgcagttaagttttgaaacagccaaaacacacacctattttagcacttattgtatttttattattaattgccaaaatatctgtcctagtatacaggatggcctgaagattgtcatccacattttcctcattgtctactatttattgaatacctactatgtaggagacacttgtgcccctgtcacttggccagtcagtccaagacctgtgggcatgaatgtttcctctaggtgtcctcagagatttttcccatcaagtcttgtctgttttctcaccttttttccctaaatgaaattgtagactctgcttagtagctcttcactctagagaatatagtacctggcagaatccccctggtgtttgagaaagacttgtaaaagtggaaatggagtcctgtgtacctggggacctgccagtctgaagcagccctttgtgccatctgcctgtacttcgtagcaagattgagggctgagaggattctagctgagctgagagtctccccatatgctttccaaattgtcatccacatgtatcaccattaccagaccctcccctaacactttcttcctgcacatggaaactcatctccattgttccctgctgctggctgagaccttgaaccacagcgcagggagaaacatccctcagagctcacctggtccaaccccatcatttcataaataagcggactgaggctgagaggctaatgccaggtttaagatcactcaggtggcctggtgcggtggctcatgcctatcatctcaacactttgggaggctaaagcaggaggattgcttgagcccaggagttcaagatcagactgggcaaaatagggagaccccatctctaaatttttttttttttttttacttagccagatgcagtgacacacacctgtgatccaggctacttgggagactgagatgggaggatcacttgagcccaggaggctgaagctgctgtgagccatgatcgtgccactgcactccagcctggatgacagaatgagaccctgtctcaaaaaaaaaaaaaaaaatttttaaattttaaaaaaaagatcggccaggcacggtggctcatgcctgtaatctcagcccttagggaggccaaggtgggtggatcacgaggtcaggagatcgagaccatcctggctaacatggtgaaaccccatctctactaaaaaaaaataagaaaaattagctgggcatggtggcaggagcctgtagttccagctactcgggaggctgaggcaggagaatggcacgaacccaggaggcagagcttgcagcgggcagagatcgcgccactgcactccagcctgggcaacagagcgagactccatatcaaaaaaaaaaaaaaaaaaaaaaagatcactgagcacacagccgtgtcgggttagctcagaggcttcgtcactgccagggcactgtagttccagctatatccagtgcctcacacaccggtagattccactggaaaccaaacagaaaggggatttaaaagaagaaagagaagagcctgaactctgcatggggcctcagccacaggcttttctcagtaggccacactgacttccccctgtcctacagtcttcattagggcttattttcaaggccaggataatcagtcatctttcaaattgctctaaaatataacataaaatttaccatcttaaccatatctatgtgtgcagttcagtaatgtttaagtatattcaacattactgtgcaaccaattttcagaacttttttaacttcccaaactgaaatttcatacccattaaacagctccctattcctccctctccccagaccctgtaaccaccattctacctgctgtctgtatggatttcactacacaaggtatctcatgtaagtgaaatggcacatttgtctttttgaaactggcttatttcacttagcatagtgtcttcaaggttcatccatatggaagcatgtgttagaatttatttccttttcaaagctgaattgaggaacaactatattgttttccatatcagccacaccattttacattcccaccaacaacacacaagggttcaaatttctctatatctttgccaacactcattattttctatttctatttttttatagtaaccataccaaatcagtcatcttcttgtatatttcggtcatattcattgaaggaatcaagtgaaagataacacattcaaaaaatgcccaatacatagtaggctgaatattattttcgttgttgttatttatccttcctgcctgcctatcatccagttttccttcttcattaggtttctcccaatcttgtggttctgagaagttcagaccctcacatgagaggcttagaaaagaactaaaaactaaaaaatacaaagaggttcttgactcctagccatagcaagtgatcttcatcttttcataggggactctacccgtttccaggtttctttgcctgaactgtacctatcaaatttgataacaccaaaccttcttacatttcctccaaggacaccctgcttcctctcccccctagctggaagaatggcccatccactgcacactgctaggttggagtctgttttgcacttggctttgtgcctagaatgggaagcactttttttttgagagatggagtcttgctctgttgtccaggctggaatgcaaaagcacaatcatagctcactgcagactcaacctcctgcagtgaaggctaaagcgatcctccctccttagccttccaagtagctaatactacaggcacatgccactgggcccagctgggaagcccttgctgactgtctcccagcctctcgctactcactgtgaatcagccatcactctcctccatgtatggtggctcccagcagcccatgccagttgcagtttcatcagcttcccagtccatgacccattgcaggtatgagtgggcagccatcatcctgaatggagttggcagcactgagcaagttctttagacacagagaaggacatgatcactacaaggagccttctacatgatttgctttttatgtgaacaaatgccagctttgtacacacatagccacaggagttggggctatgtggaagtcctctgaaatactaattttatattatgaacaaagcataaaccctgcttctgaatccattacccaaaattatttattaaaaagcattattcacttattctttcaagaaacttttattgtgattcccaggtgctaggtgttgttctaggcactggggattcagcagtgaaacacacgctaagttctccatcccctgagtgctagtcaggcagacagactaccaacaacactaataagaaaggtgtatattgctcagttatacaggtagcaaggaaaggagagacgatgtatctgtgatttggattagaggccaaggcagagattttagataaagccaccagggaaggccttgctgagaaggtaacgtttcagtaaagatggaggtgtggaagcctcttatgggtttatcatgtgtaaatgtcagatggttaatattaaaaatgaaatcttaatcattttctagcactaggtggtttacaaagtactttccaaataaaataacgctcataaagccttgagtacaggacctagaacattgtaagcactcaatcagtggtgagggtggaagctattgctatgatgattgacagtggcatcagcacccggtggctatcttgtctctttagaaagtagccagcccttctactgtggctaccgtggatgtcatgggggcaggatgacctcctgcgtagctttaagagggctgaatccacccggctcccttcattggaggtgtctcaaggggccactacccatgatcaggtgctcctgtctttattcctccagcctgaatgagccctccttccctttgctctcattccaagcagctttctctgctgcagaatctaaagcctggtccctgcagtagtctcagtagtagctataatttgtttatgattagtactagttctccaaggtacagttgaaattgcattgtttactgaacaaacaagaggagaaaatgacatattttacggggaggtatggtgcagaatggttacatgcaacccctttgcagggagattaatggcaaaatagacacagaggtcatttataatattacagatgaaattattggtgtgtgttttcagcaaagcaatgaagataaatgttgaataggaaaaccttaggaaaggatcacacaacaaaataaaggggctatggagactacaaaagaataagaaaatttttaattccttcggagaacccgaccacaaaaatgaaacgcactctgccttcctgcgggtggcctacaggaatcttggcggttctcagtaaatctatacggagactgactttgtcctaggatttggaagttggaaaccagccctcataggctctgtcatgtcagacagccctggtcccaccctagtgccatcctttatgttgtcctctctcaccatcacctcgggccccctgccagtcctatcagggtctccttcgtatccactcacctccctccatctctatgtcaccagcctcattcaagctgcctccgtgacttgcttggtcggttacaacagcagcctgccaagtggtttgcccacttccattttctctccatccattcttccggaatcactcagaatgatctttctaaagacttagatttttttcagtttcttgtctaaactccttaaataaggtccatgctccttgccacggcccacagggtcctgcctggttgggccttggcctccctccgcagccacccctcataaccctctgtgaccatctgtgaccctcttgagacgtactggcctcagctctgcttctagatcaggaacatcctttcacacccccagccttgcagtttccgctcctccacagcctttttcatggctgattctctctcatccttcactatcagctcacatatcacctccacagagaagacacatcacttttttttttttttgagatagagtctcgccctgtcacccaggctggagtgcagtggcgtgatctgagttcactgcaacctccgcctcctgggttcaagctattctcctgcctcagcctcacaagtagctgggactacaggtacatgccaccacatctggctaattattgtatttttagtagagacagggtttcgccatgttggccaggctggtcttgaactccccacctcaggtgatccgcccgcctcagcctcccaaagtgctgggattacaggtgtgagacaccacacctgccatgttgctctttcttcaccactgtcaccccagtgctgggcacattgtagaagctcaaagattgaaatggagactggggaaggtgggtgcaatttctgcagtgcaacccaaaggaatgagtaattcctagcagaatgcaaggaaaccccacctcacgacattcttctactgaaactcggtgatctggtttgtattatttgactacatacattagcacttgctatgtgacaggcactcttgaggagactgaataagtgacatggactccctgcctcaaggaatttagaatttagtgggagaagctggcaatgcagatataaacacacaataaagtgaggcaaggcacagccaaaggtatgcatcagcaccccagagggagatgcgtgtctttcttcaagagagaagagcaagcagttggggaaagtggcatccaaattagcaggaattgttgagatcaagatgattctagacaacggaacaaagttacacaaaggctgtaaggaactgcacatcccgatgtttagctaaagatgtgaagggacatggcagagctgggatttggactgaatgctacagaaaccagcaaaggtttatggtaagattaggaccaaaaaggagctgacctcagaaagctgactctggtggtgaggtgactccagagacaactaatgctgaaaacccatcattgcaagtataatttttcatagctattatttatgttggaaatgactcttgcatttgtttcagttattgttttgctgcaaggatctaacagagccttatctctactgtgtgacatgaggacacccaaaggttctctctgtcccaagatctggcctctgtaaccccctcactgacccccttcccatccaccctccatagctggtcctctcaaagtccttaggatagtctctgaagttagcccataataagaacccatgtattctgttatgtccacatgatttcgtttcatcctcacataaatcttgtacattaggcagcatccccaatttatagaaaactgcaagctatgtcagcattcaccccactagctagtagaagatgggggctggagcctagtattattttctctataccttaggcagctcatcaacacaaactgaacaaagtgggtccttgggcctgcaagagtattcacagacatggaaactaggggcgaaaggcgctcttgagaatactggaccaaggagaaaatccttgcaatgagacggtgggggtggtgagaagtgctggaggtcttggaattcctctgcgaggagaaggaactaaagatccatttctcaggcaccagaggttctcagacttggctgtactcaattatcacccagagagcctgtggcacctgctttttccaagctccccacccagatcctctgattctataggactgaagtcaggcccaggaagctcctgcgtggttctgatataggcgtgtgtggacacaccattaatgcaacagcctaagcccatggcaactatgaatggctggctttagagggtttacaaacaaggaaactgaggcccagagagaaagagacttgttcatggtcccagagggctgatggcaaggctaggcctcaaactaactctcccacttcccggaatcatgatttcttacccagcccaccagcagccatccatagcaagacccgctcctcgctgatttacattttgagtcatagaaacccaagatgccagctctttaatgaggttgtccacactacaactgaggaggcccaaagccctcagcaggactggtctctgccaggcttaatttacacagttctcaggccttctaatacccccattaacgtcagaaaggaatctgcagctgttagtctgtgcactcgactacattctcatcatgtcaccatccattttcatgtcttgaggctgttgagagcctgattttcctagtccagatcatggcccagtcccctagactccagctccagccccaggtttgacctgagtcccctagacaccaggttcccccacgtgtcgtctcccctcactttaattgaagagcaagacccccttctcactgaagcagcactcaaatttcctcctttaacgagtgtcattagttaggcaagagcaagcaggtaggagatggccagaaagctgatagaaatgtgcctttttaaaatgacacataaatcaccctaattaaaaattaagcgccctaaaatgtggcattcgtttaaaaaaagaaatttgcgttaggagagttgtgtaggttttgtagcatcaaatctctaaaacacgattgaaagagcagaggatgcatgggtttctgtttcgaatgcataattagggaagaggcatcattctcagtgagtgaacccaataaatcacctgtggtgtagaacaggaattcatgtaacctgacctgggccacatgtgtctccagtgcaaatctgaactaatttctactatatccagagaggagataaatgggcaaacaaatgtggcctgctgcttcaggagagatgttccaggatgcaagtgacagatgactgagacaggaaatcccactgagaggcaagtttgctgggtgtgtggctttggaaagatgccctggaagggagaaggcttcaggggagagtcattaacaacagccagcattaataaagtcgacactaactctatccaatcaacctcataaacatgcaaccaccaacagctactgcccagaacaggacatcagagaaggaagggaccttcgaggcaggatttgagatcaacagtgaagatagtaaaggtgaagaacccatccctgatacagaggcatctcagcccaagatctccaggcctccaaggaaatgatactcaaccatatgcccctgagaattgcctgaggaacagtttgttgttgttgttgttgtttgtttgtttgttttttgagacagtctcactttgtcaccaggctgtagtgcaatggcatgatctcggctcactgcaacctccgcctcccaggttcaagggatctcctgcctcagccctcccaagtagctgtgattacaggtgtccatgaccacgcccagctaatttttgtatttttagtagagatggggtttcactatgttggtcaggctggtcttgaactcctgaccacaagcaatccacctacctcagcccaccaaagtgctgcgattacaggtgtaagccacggcacccagaaattttaaaaccaccagtgccaagagtctatcctccagagatactgatttcattggcctgaacatcaaaaatattccttacttcccaagtgactcccatgggcagtcagggagcctctcctagaagacaatttaatctgagtcatgggagaggaactcgagctcggatcatctcaccaggtcttgggcccctatctgtggtttactagctgtgagaccacttgcaaagtacccagtaagtcactggttaccttctgtagttctttgttgtctaaaaatcatttctctgtgcattgtgtaggctctcacatcctcagtcttctgattaatcaaatgagcatattactaacggtccttccagtttttatgagattcaaacgaagggtaaagaaaacacattgtaagctattaaaatgctatataaaggtaaccccctgtgatttacattgttagtctgggggaagtgccatttcaaaggctaatatgtaaattcccgtagaaaggaccctcactaataaaagatccccaagcaccgactcttcccagagtggcttgatctcagatctcccttacttttgcctattagggcatttaggtgtttcagtggttaccaggaaccacatgggcagaaggcatcagaagtgtcaatgggaaacaggagctggcttttcacgtctaagccactgcccttcctcgttgctctgcaggctgtggccagccggggcctcaggatactctacaccgcaggccagaacaatcattttataaccacagagaagatgctgtttgggaactcaggcccttgattaaaatcattcaccaaggatacattccttcttggaatttatgggccccataaaaaacagaacttgagaagacagagcgttgttttttgttgtgcctcgttagtttggggcttgggctggcagtagagatcacagtaccaggcgtccatctaattgactcttctgcaagcacaaagctccctgtgggacagagaaggccgtgccagggagcctggaaatctccattcggggaaggagactgggcggagttggtagcagtgctgaaaacgtaggcacctctgggctgctgctgtgcttccacccaggaagacaggtcctggggacaaaatccagggcatcagagagtggaagccacactggctcctgctcctggacctcctcctttgtcaaggtgtgtgggtgaagggcagggatgctgacagcctgaccttccatgcccaccattaccactccttggaggccgcataaagaatagagaacaagggatctaaatcagtgggtttccatcagtctctcagccagccactaaccactcggagctttggtattctcaactatcaaatggacataatgagaccttccccagctaatacacaggatgagttcaattcccaaatagggagaatttagatctttataccagacactgtctgaggctcttgaaggtgagacttgacacctcccccttcaagtcacttgcagctggatgaggaagtcaggcatacaagccatagtaatgatatgtagcagtgtctaccacattaattgtaagaagaagtaatgtacccaagggaaagggacattcatggaggggagaatccatgaaaatggcacagatgaggtggtgagatctagatccccagggccgaaagaggaagagttggtggaaggtgtccccagaggagaggggaagccaaagattccaaaggataacccacatgtgacctactgatcccacatggaacaaactcagtaagcatccatacagaagaggaaatcaccaaggaaaatatgaatagggaggcatcacatgaaaatttcaggctgggtgcagtggctcacacctctaatcccagcacttcaggaggctgaggcaggaggattgcttgagatcaggaattcgagaccagcctgagcaacatggtgaaaccccatctctccaaaaaaaaggcagccaggcatggtgctgcacacctctattcccagctatttaaaaggctgaggtggaagaatcacccgaggtcgggaaggtcaaggctaggacgagccaaggttgcgccatgacgctccaacctaggtgacagagaccctgtctcagaaaatttaaaatgcctgtttatcaaaatacattataaacagaatgaaaatatacataaaatactgggaaaaattgtcacgcatatgataaatagttttgcatccttattaatgacctcatacaactcagtatgaaaacaggaagaacctaatcgatacgttggcaattccctaaaaaataaatttggaaagaaaaaaaagctagtaatgtgagaaaaaattcaacctcgaggctgggcacgatagcttatgcctgtatttgggaggccaaggtgggcggatcacttgaagccaggagttcaagaccagcctggccaacatggcgaaacctcgtctctactaaaaatacaaaaattagccaggcatggtggcaggcacctgtaatcccagctgcctgggaggctgaggcaggagaatcacttcaacccaggaggcggaggttgccgtgagctgagattgcaccacggcactccagcctaggccacagagtgagactctgcctcaaaaaaaaacaaaaaaacaaaaaaacccaacttcactggctatcaaagaaatccaaaataaaacagcagagggatacctttagttaaaaataaaaattctggtaaaactcagggttggccaggaggtagtatgagggatgtgcctgtatgaacacagctggtgaagagtgtaaattggattaacttctagaaagcaatttggcaatctgtattaagagcctttaaaatgtttataccttttgattcagtaattccacttctgggaatctatcctatgaaaataatctgcagtgcaggcaaaggtttacgctcaaagatattcttcaaagcgtcatcataaacagactagcagcccaatcattgaataatgtttaaataaatgatgggacatattgcacaatattgtagccattaaaaaggatttttatgggaaaattttaaaacctttggaaaagcttgtgatacaacctaaattattttaaggcctatatgtatgacacaactatacatacttataaagcatgggcagaagaaactaaaccaaagagaaatctaccaagatgttaaaaatggtggcctctgggtggtgggattctgggcattttctttgtttcttttgaccctgcttttgaacttcagacaattggattctgtttttagaatgaaggaaagtaaaagaagctgtaagacctctttgaggaatgacaggtgattggtgtgtgaaacacccatgcccattgggacataaggtgtggatgaaacagacatagcctagatttgttcaggaggttgagggagacctcatagactttttttttttttttttttttttttttttttttttttttgagatggagtctcactctgtctcctaggctggagtacaatggtgcggtcttggctcactgcaacctccgcctccctggttcaagcggttctcctgcctcagtctccaaagtagctgggactacaggcacgtgccatcacacccggctaattttttgtatttttagtagagacggggtttcaccatgttagcccagatggtcttgatctcctgaccttgtgatctgcccacctcagcctcccaaagtcctgggattacaggtgtgagctaccacgcctggctgatttttaagttcacttatgttttctgtggcagggctgggagtgagggtaataaggtcttaactatatttaatggtctcctgtggtaaggcataagaaaaagtgatttggaaacaaaatcaccaagcaaatgtgagaacttttcttgttatcctaaatacctgtgccttgaaagaggggcaaagaggacactggccttccccattttctcctactaagtagaaagaatagaactccctgtcctggttgttacaagtttagtgagcaagcaggtgctgcttctggggtgctctcgactcctgggacacagccccgtcagctccccaggcaagggggcatcttctcccactgttttagggagaccacaccttccgtgggaccagcaccagtgtgtgcagaaaggcgttttaccttctagcttccaagaggacatgaatgataggtaaagaattgatgcccaaaattaaagctgcaaaatgaatttgacattttacatcctaaaatgagcattgtatctcgttctcctgttccctctgtactttgatcctgtgtgtttgtctgagaatatggcctccatacagtgggggattgattccaggacccccaaatctgcacaggcccagtcagccctgccaaacccaaaaatattgtattttccatccgtgttgggtgagatccatgtataagtgggtccaaacctgtattgttcaagggtaattttttgttgtgcattttcctgcacttagaatctataagttatctggggaaaccttgcttaggctatcttgaggcccaggaacgaatggagtggtgtttttccttctgtgtgagtaagaaaaaggtagagatgaatagtccaggggaccacaaaggtctagtcacaaaaacaaattagagcactgagaagtggatctaaatctactctgggctcccagtgatgggagcctcggctgtctgggatttcagcgggagtcaggtttcgatggagtgttcattctctattgctgctgtaaaaactaccacgaacgtaatagagcaacatgaatttgttcttttacagttctggagggcagaagtatgaaattagtttcactggactaaagtcatgtcaggcaggccaggttcctcctggaggctttaggagaatcgcttccttgacttttccagctttcagaggctgccagcaccctttggcttgtgaccccttcctcccactactccaaacgcttgcttccaccctcatagtcccctacttcttactttgactgtcttgtctggtgatcacattgcccataccccccaaccctagatattccaggttaatatctccagctaaagattcttaatcacagcagcaaagcctcttttaccacataggtaacattttcacgggccccagggattcggatgtgtctatttgggggtctgctattccgcctactgaagataggtaacctaatgtgcaggcattcatgaaccctcctaggggccaggcactggctaggcctggggtgaacgccaagctcacacaacttgatgaagatgatgggattgtgcacaagcgttctggaggcaggttgcatggaagcagcagctccccaaatggaggtggggaggaaggtgtgaggattgtgccaggcagtgtctgtgagctggacctggacggacggcaggatttcaatcagcagagtatggggtgcatcatcacacaaccatcacatgaccatgttcatcgccctctgggagcctgcagcacagagtccatgagcagaggcagagggagaggcaaagcaacttaggcccagatcacagggaccttgaagagcaggtgaaagggctcagatatgattccctggaaggaggtgggatctgttttcccattactagtatttgcagagaatgcccagtaggaggcagggtggacaatgctgggtggccgtgtgctgtcatctgacaaactctgccttatctggactaccctagaaaagagggcacaaggccacctccagcatctccttccgtgagatggagagggcacctttacagtcagagaagctgggtgtgaatcccacataccaggtgtggggcctgagataagtcactgaacctctctgacctcagttttcccacttaggaaatggacatcattaagacctgtctagtttcctcacagggccagatgtgctaaagtagatggagaaattccagaagtaaacaagctgggcttcatgttagtttcagtgctattaggaagagtcctttgaaccaggaaatcatggacttttagatattaaagatcacctaacctggagagtacctcatcagaatcagttgagtttgatttgcagccagagttggaaaggccccacccccatgtgaggctcagagaggctgggggacttagccaagtggggtcctagttcatcttcccccactgccctgagcactgagatgggtttagcaccagctatgaccaggatagagctagaaaacaaggcagagagtaaggcaggctcactcggggtgttgacccaggtgagccctacctgctcatctccacaggggccagagtctccccatctgacatcagccaagaactgagtagcaggaggcaccagccaggccttgtgaggtggtccccaggcaaagccctccatttggtcagggaggctaagccagaccagccttctccttcctgttgtctgaatctctggggcctgcaaagatgtgagtggtcacaggttaattcattatcaaaatgcattgttcttaatccagaaactgataactctgtatgttcattataaactgcccccatcccttccccctctggataaaattaattatctaggaatttcagactagagcaaaccttagcaatctaatagaaatccctcctttgatagaggatgggacaggggccacacagagaagggacatggtcagcctcatacagccaggcaggaggatccaagtccagatctgaggcccaggcttgcatgatggtgttctttgcattccagaacagaaagtgctgcatctttctaatatcttctcaataagtcactccagtggtagaacctggggtcaagaacatgggggacatgcactagaccagatccacctcttggtaccccaaatttgaccttgagggtggagctatctgtgcaggtgagactccacctggaggccatccacttggcacactaaagtcatgggtttgaggacccccgaggaggaatgtcatggagggaacatggaccactctgctgctcaccttcctagaaagtgagataccccagcaggccatggatgagcgtgaggggttttgacccctctccctgctgatgttggccctgggttggccagatggagatgcagatgtctcaatcaggccttggagtgtgaatggcagggcaggataatgctgtccctgcagcctgcccatgggaccaacccatcaggccagctgctgcctggggccatgcaaacttaccatggttgtgtgtctgtgtgctctccaggaacatccccaggctccaagatggccctgcagagctccttcacttgttggaatgggacagtcctccagcttgggcaggcctgtgacttccaccaggactgtgcccagggagaagatgagagccagatgtgccgtgagtagatggggctgccccaccctgcctgagcccagcccatgctcataaccccgttgtccccattatcccaggcatgagagcatggacagccttcctgatatccactgacacttgtgactcctctcatggcaaagccacacagtcttcaagaggcagagctaagatttgtggtctagaaatagcctggtccgtagtcatataagtcaagaaccaaacaagatcttgtaagtgatgctatcagcatcctcaaggcacagagaaaatgtgcaggataaagcccagctctaatgtgacattggaagtcctctatgcccagacttccctcgccttccaagtcccattccccacctgcccctcatcctctccctcctccatgcaccccagctccggctgtatggaaccaccttacagatccttcatgcctccatggctttgctcacatggtctcccctttcctttctcgagtcacatctacttcaagactcgccctgagtcgattctttcagaaagcctccctggccatcccccacaagtaccactggttcttctccctctggatccttcccccacaatccagtggatccatccaaatatcatcattgccattactttttatgaatagttttgagatacaattcacatacaattcacccacttcaagtgtacaattccctgttttccatatagtcacagggttgttcaaccatcatcacaattttattttagaacatttttatcaccccgaaaaggaacctgtagtatctctccccattttgctccaaaccccctgccattagcctgaaccaaccactaatctttgtttctatagatttgcctattctgggcatttagcatcctacgaggggcccactttctccatatctttgccaacacgtcatattatctgtctttttaattttagccatcctagtgggcatgcatccattatgttttatggaggtgatttccatgtctctcttcctctctgtgggtggtttgagtctggtcatctttcccatagcaatacctctcatgattcctggcacagcgtctgtgcttactgactcttcattgatgagaggaaagaatgagttgggaaacttggactccataggggaaaacaaattgccgaggccccactggcagtcggggcggagtagactcccagctggtgctcctgcacttgaacatggtgctccccgcagctgcctctccagaagtaatcaccgcagagcccttgatgtttttgccactgaaaccaccaacgcttccagaatacctacaggcagctggaaaatgtgccagatcctggagcagagatgaataacttggcatcttccctcaaagcactgaaagcttcacacaggggcgggagtgaaatggagcctggactggggaaggaggaggcagaatggtgcctggggtggggcccagacccggagcaaatgcctcacctcccagatatgcagaccccagtggcctgcaaggaagtttccaaaatacgttttaaaacagggccctctgcccccagtcatctggaccctttgtggggggtggagaaggtttcatttattctcatttaaattaagcaataaagacattcattttcccatttttaaaacttcatttctatacaaaactttcaagtgaagttttccaatgataatggaatagttgtatgtttttagataaaactcagcaaagagttacagggaagggctttgcttaccctgttctgttccgctcctggcctttctcgtatagttctcactacacacatggcccaaagtgaagccagtcctgcccacagtgccctgttcaggggcctgtgtgtgtgtctctatttatttgtgtctgcagtgtttccagcagtgcctctgaactctgtgatttcgcgattgcctttttcaagttttttgatacctacttcccagctgggacacaggtcgggcaggccatgccctgattgacaattgggaaaatgaaggcacagataaggcaattgacttgttcagggtcacacagcatgtcagggacagattagagccctgaaccttcaggatccagtccattactatgggctcagggcatttcccaccactccaaagcttaccactactggtttcctggccagctccaagcttcagggcagtctacttcaggcactgagggcaagaacctggggcccagaggctttttcagccacatttgaaaagcggctctgacaagctgtcagagtaacccctccaccctggagaacacccccactgtgttcttggctacagaaagcagttgctgggagggaagttcaattcaggagagttattcccactcagatcttagcaaaactcttagaaaatatcctttttcttatttgtgtgccctatcctttccggcatttttgctgtgttccccatcacactaatgttgactctgaaaaccattcccatgaagataacaacagcaacaacaccagcttacctgttgagcctttactctatgaggcaggagctgttctcaacacttttcatgtaggaacttgcttcatccttacaacatcctgtgtgatgctattgtacccatctttgttagagacaaggaagctgaagctcacggagtttaagtggttgtccacgatcaaactgatagccagaagctgagcagtgattcaggctcagtctgacttcagagccacactcaaaccactgcagggtaaactctgtttcacgagcttccagcacttagctatgataagcactgaacctagccacagacacacccaggatgaaggggccaggaagagacagggaggtccagggccctgctaccgcctttctctgggggcctccccctctgggtctcgggttcctcatctgtaaagtgatgcctactgacactctgaggtctgagaaacaagcaggaagtgtttggagcagctcctggcacaaagtaagtgctcagtaaatgttagccagtattattcatgttattattttcttcagggggatggtttccagaatcaacaccaacatcataggaaaatactcttgactacaccagctctttccaggtggtctggaacctgttaaaatgtttcctctgagcaggtgttcacactgcagctctgttaggaatggccaggtcctctaaagaaccttcctgagggtctttcatcttgggccagggtagttgaccaaaccctgccatggttggaatttggaaggggaaagtaggttgcatttaatcaactccccctaccaaaagccagcctcaactccccacaccttcccagagggagtcctccgcacatgctggggctgcaaacagattatcagactcactctgggcaacgtaactggatctctttggagcccttaaaaattctaacagttgtccaggatgagtggagggcctgagatggaggtgacattcccttgcctttttctagccaatcatgatcctcatatgtccactgtactctctcctccaaacccacactccaacacagtactctcggtcccctctccaatacagccactcctgcatttctaattaaacatcgccaaatccaagtgagacatcccagatgctgtaatgcactgaagggggtcttcgtgactctctctgcgttctgaccaatggcctcgatggcatgtggctccctagaaaggggccagatgttcccatttcatcccctagatgggtcagtgattcactaggtattgcagacagatcacttttcccccatggacttgataatctcatctgtgtgctggggatactcttcctgccaggcaaaaacagtgttttaaaagtgtatttctttattgtaagataaaacatactggttgtaaaatacagaaaatctagaaatgtacacaagagaaaataactatcgcccataatcctccctctcaaacattcagagataactgtaatattttgatgtatttcttctagcatttttcccatgactctatattttcaagaaaatgtatagcacatatttatcaaaaatgttaacagagttgtcacgcaggaaggaaaagaagtagtgtcatttggcctggagtttatacttggcagctcccacagctgctgctgaggtcacagctccatgactgtaccaatttgtctctcttagagtggaatcaggtgtcataattgccaaatgttgcaggattgattgacctacccacagcgcgatttggccatccagccaatgaaataactggctacagcccaagaagggggttggttagaacagtgcttctccagatttaaggtgcacaggagtcactaggggagcctcttaaaaatgcagattctgattcagtgggttggggcaaggcctgagattccacacattttacagattcataggtgatgaggctacagctggtccctggaccacattttgagtggtaaagagttagaggattgagcccactccccttttgttcagcaaataagttttgaagtcttccagtgtgctgactgagtaggagcttggggcgaatgagaagagaaaaggatgatcagaggatgagttgataccattagacccaatcctgcaggccaaccttttgctcagcaattggccttagtggtgatttcccagttgcagcctaatccacaggggtctttgttccgactcttaaccttaacccaccagcttcctcaggagtggcttctggctgagcaagctgccctgatgagtttacaatcatggaaatcctcagctctccttcctcccttaggggttttaattgccacatcaattgtccactggcctgtcttgctcttttgcctgcctcctctcccgttattgagtcagccagaaagaaaaggggtttccactcccagctcaccctggattctatgccaagctgaaacaagaatgggattccagagacagagaatgctgatggctttcttcagtggctttcttctgtccagctgaaaggcataggcagagctatcacatatgcagcctccaacaagcatttccagagagccaggcagggacttgctgtcagtttcagccatactctgaagaactagctccaagttaggtgtgaatggcaattaataacactaccaccactttacatttgcacctctctggctgtttacaaagtgtttccacactctctcccctactttatcctcaaaccagctcagtaaaatagacactaatactgccccattttacagataaggaacctgaggctctaaggaagaagggacttttgtaaggtcacaaagcaggaagtggtgaggctagaactagagcccatatgtccggattccagtgctgttgtgctaacaatacccatgatccaggctcagttctctccctctgcctcctaaaagggtaaggagggagtgacgtactgtgcatctcccacctcaggccggcctcctccttcctccaggaatccatcacccactggaatcttccatcatgggccctggggtgttttgtttgtttgtttttgcttgtttgtttgagatggagttttgctcttgtcgcccaggctggagtgcagtggcacaatcttggctcactgcaacttccacctcctgggttcaagtgattctcctgcctcagcctcccgagtagctgagattacaggcacccaccaccagacccggctaatttctgtatttttagtcaagacagagtctccccatgttggccaggctgttctcaaactcctgacctcaggtgatctgcctgcctcagcctcccaaagtgctgggattgcaggcgtgagccaccgtgccctgtcgggccttggtttttaaaactcacttgtgaaggacactccatgagaaggtcacttccaccagttggtttctgcaagagaagtagatgtgggatcccttgagggggaaataaaaaataaaacagaaagttcttcttagctttgggatttttaatcatagaaacatgtggggcttagggggaaattatttcttcaggggggtataaatgggaagagatgttcaaagtcagtgacagcctgttttaatttataattctgcctctgtgtgaaatgcacagagaatctgggggaaatgagtaataattcactaaggtgctgtcacagccaggaagcgttagggccctctttgtcagcctgctgctgccaagaaggctgagacagaggaaggacatgcagtgctgtgggtctcagctagagagcttctttcctcccacatggagacacaggcttctctgcagctaggctgggaggtgttgggggccatcagaatcgcctggaataggccactagctccttagggctgagtgcctttcctggagccatgctcagagtgagctggagaaagtgagctctctccctcaccctcttatcctttcctcttccttctgtgggcagttgggaaatatacagtctagaaagctgactgtcacctcttcaataggacctgagatcagtctgatgtagagaaaaagatgacgtgccctttgtgctgagcccactgatgatataaagaggccccaatgactgggattgtttgatcaggacaggctagattatgctgcagtaataaaccccatatctcagtggcttgggataacatttacagtacccgtccaatgagggtgtgggtgggaggggcctctgctccacaggatcactcagggacccaggctggcagaggctcctccgtcaatatagtgtcacccttaggaacaagaactttcattggttgtttcagcaagggaacagagagaccaaagatttacacaagggcttttagcagccttaattcagagaagatacatcacttccactcacatttcattggccagagcacatcatatgtcttcacttaactgcaagcgggttgggagagaaaggaaagcaaatggaaagttttgagcaatatgtgtctctgcagacaggtaatttgatggacccagacaaacccccagccaacactaccacaaccaccaccacagtctggacattgtatcaaccattagaaatgtagtgagctatacagtggcttctcctggggtcacattcatggtggctgagtataaagagtgcagaatttagaagcagaagacctgggttcgagtcctaactgggttatctgttagctgtgtgaccttggtcaagttgcttcacatttctgagcctctgctttgtcagatatacaactggactaacaacacccatgctgaagagttatttttcctattttgttttctgtagataagaaaactgtaaaccagcacgggcatcagttagggcttgggggcttctcttcattataatcagtgtcattagtcatccagcattctggctggggagctatattactaatgaagataatttggtcatgcctggctaattcgacttggcattggcatattttgcctttagtggtcctgaaaatgatggtgcctctctgctctctccatagggaaactgcctgtgggtttttactgcaactttgaagatggcttctgtggctggacccaaggcacactgtcaccccacactcctcaatggcaggtcaggaccctaaaggatgcccggttccaggaccaccaaggtactactgctctcctgccttctctctggtgcccatcttcatgcccacatagacagatgggagactcagggctggacttcaccccacctgcagggcaagctcgggtgtctgaccaaagcttgcctagagcgttcacacacaattccctcttcacaccttgggctttcgagtgattaaatctggccaagatagatgtcacctttggttacttaaaataagaaccatgaggagggattaacaaaaagataatagcaacaacgataataatcctttccatcaacaagtatgtgctgagggcgtcctatgtgtcaggcacataattcattgagaggcagggaaagccatagccctctttatgactggggagactgaggcacagcaagtccttgtgtcatttgccccagggttgtgcccagggagcctcaccctatacccggtccatggtccattccctgcagcacagcctctccagccatccccctacctcacccctgatttaagctagtaatgcctgtcctcccctctccggggtccatcctccccacaaaccctgcgtgtctggcagagagcaaagggcctccacgcagccaagagatagccagcccctcctgggtaagctgactccagactcagagacaccaggctgggcaggatgtgggatcacagagggtctatatggccagcagagctcccaacgttaggctgctggagaggccaggctagccagccttgggggctgtccctagtggtgggacccgggcaggccctggtgcccacctctctgcagcatagggctgatggggtgggaaggtctctctccttcttctgtcctcttcatttgccttctttctatggaactagagaccctccaatgcttatttgttgaacagtgagttggctcagtccccactgtgcagcagcatccttcttagcattctgtctgtaaaagacgcagaggagagaaatggagttccaagctggatgtgcccttcatgtctctgttcccagtttgataatttccactacagcacccatagcaaataagcatccagccctgcggaataccgccagtgacagggctcccactgcctcctagagcagacatgctgttgttctcaatcacagattagctttccttacctggaggcaagctccacctctccatgacttctactcatttatcatgccttttgccccctggagccccacagaactgaactaccccctctcccaccaaggcagcccctcagaaatctgaagggaacaattgtgacccgcctgcctgcatgagggcttttctgtccccagtcacacaatgccagctccttgaatctccctcatgcttgctgagatctcttggttactctgcccttgacccacccgaatttgttacttaataacagcctttactgagagaggcagaaaggtagaaaggaaagactaaagtataatgcttggggttctgtggccccctaaagtgttgtgagctcacaatggcactcataccacagcaccggccacgtacaaaatgctctgcagaccctgaaagtttgcagatgcttcttcccaccaccacgtgtggatgggagcccctgttctcccagattttcaggcagagccatgcttagaaaatataagaagtgagtcttcatgggcaggggcacaggacgacctgggttctggacaggggagaagagagtgaaggtcacagaaaccactggaaggccacgcatgactgaaaatggggagggtggagctggggaggccagtgtgcttcaggctagtcctgggccatgggctaaagctggtgaccttggaagatcagggatgtggtagcccagatgatggtgctgggacctcacaggcagtttagaatgaaattgttggccaggcgcagtggctcatgcctgtaatcccagcactttgggaggccgagacgggcagatcaccaggtcaggagatcgagactatcctggctaacacagtgaaaccccgtctctactaaaaatacaaaaaattagccgggcgtggtggcaggcgcctgtgtagtctgccacttgggaggctgaggcaggagaatggcatgaacccgggaggcggagcttgcagtgagccaagatcgcgccactgcactccggtctgagctacagagcaagactctgtctcaaaaaaaaaaaaaaagaaattgttgacaggtgggctttcttctccattgcaggccagaaacctgtttcctcaaagatatccctaggctagataagaactgtgcacagtccattaaccctgcacccctggtcccccagttcctgataatggcgtgcttgtgattcttttcctctctcctagaccatgctctattgctcagtaccactgatgtccccgcttctgaaagtgctacagtgaccagtgctacgtttcctgcaccgatcaagagctctccatgtgaggcaagtctccttgtttctctagttctctaatttctcctcccacctcttgtcacttccggaacccagattaagaaagtagcctagctggctgggctggtcgttctcctggggagagaacaagagggccacctctgccatcttcgaggcagagcatgtccatcaacatggtaaagccctatctacagagaatcatgccttaaacagccatacccagctgcactgaactacttgcagtagaaccatgatttaatcaaacccagaagagattttccatggcataacaagggagagtgacaaggattgcaaaagactttctacagaatcctttttaaaaacattgagctcttgtaatacattgtaaatactatacatcctcaaaaatttgatttacataaatttcactaagacatcaatggcattcagtgaggtacctccaaaactactctctcaaatggttcctgatgctgttatctcattggtgtgggtggagggactggcgccctgttccttagcatacagtcatattctttaggggccaagaaatgtacttaagaccccagcatggtacagtgattaagctcatggactctagaatcaaatttctgagtccaagtcgggttccaccactgattgattgtatagtttgtttgggcagttaattaacctcttggggcttcagtttcctcactgggaaagtgaacacatttatagtgcctatcctgaagagtgaggattaaatagataatgtccaaagggcttggaagagcattgggcacaaagtaagcactgcagtatttagcccacagggtgcctggcacactgtatcaacattcagaaggacactgggggaagaggaagagaacttgagccagaaatcagactgtaagctccaagagagcaggccatgtcttgtgcttctttgtactccctcactgcacctgcatcaacatcttgcgtgtagtagaaaacctacacgtagtttgggtttggccagtcatctcgttctggacactcacaggagaaattcctgtctggctcagtttcaggaatagctatgcaccctctgagcaatttgtttcctgtcaagttgtagacattgtgaaactgaccagattcacttctccttctgtggctaatagaaatcccagggtggtggttctgtggccagcagagggacagacaacaggattgcccctgctaagggatgcaggcagaatcaagcccctcgagtttctcataaaataaaaactcacagacagaaaacaaataagaatggaaaagatgtagaaatgattttttaatccgaggagtggttaaattaaaaccaaggctccacttggcaagcaaatgggactttgtgatatgcaatttgtagcagcttactcctggtttgattttataactcgacattcgccacttccttctcaccctcttctaggctatgctatcctactagattttatgtatctctgtgaaccaccttaaatcctttttggaagaattctgagcacaaataaatagattcattaaattaaattgtgtttgagaaaccatgctatctcatgcagatggtggaattacacagtcattgctgatatttctcaggtgtctgagagcaggtacctagaaaggaaggctttttgagagaacatataaatgaagacagatggttggcccaccggagaggacgggaggatccttaagagcatttggtctttaaatttactcttcgctgggtttaatatgagccaaatttcagaaaaagaaatgtcaaggtacaaatgatattattctaatacttcatcatttctctaataacctttgagttgatcaatagcttaaacaggtgtttcgttttactggcctgttttatttttcctgcagtctaatttgctctgggctgtttctgctattccctgcccttttccagaacttggctcagcaggcataatgaaaggaagggaataagtccattccacactcacattatttatatttatatatattcatatgatttcacattcaggttttcagaccatttgtctaatgctgatgggtctttgaattcccaatgttgggagaaatgtttttatcaggaaaataaataaccaaaatagaaatatgcatttctagatttgtaagccctaccatttattttatgtgaatcctaaatgcagaatgcaggaagttgatttcctcctcccgggcgggctaaaccccagtggcagaaaaaaatggatattgcatttctctgggggactatgtgaggttcactcagggctttcaaaccccaccaaccctacaggggcctctgttgcctatggggcccgagtgcagaaagatggacactaggcagagttttggggacaggactctgatgagcatcaggcctacagggactggcgactggtccagctgagccctgaggctgatgcctaccacgaaggaccttcttcaaacccagctcagtcctggtctccgggaagttaaagtcatcgtacactatctcaagacaccacaatcatcagtggattcccagagaagaactggtgtcatcttcaagaatttcctgcaaagtctagaaagtgagttaaccagtagttctgtgtttcaccagtcacattcacctggaaaatgtaacaaatgccccaccctggacctactgaatgacatcgcgaagagtggggcccagggctctgcatttttaaaccctatccttggtgatttggaggtgcactgaaacttcagagctattggccgtaggtgtgcttgccaattgtgactgaaattcattctgagcccatgcagagagttttcctcctgtctgtggccccaaatagcgtgatgtcacttgtcttttagaaagatgagtcagaaaagggatgagaaatgatggaggcgggggagaagagaagcgggtgggagagcatatgaaaccaggtcaggagccccccatgatggaggcatagccacagtgtgcctttgtgccaatctaacttccagggcattccagaagcctgccccactcccacctcctccctccaggctcctgcagcctgctcttgctgactaccacggctgcctcctatctctctgcacagttacacacggggcatgaatatttaaagacctctgcctcgcccagccacaaacaagaaagaacgctgtggttttggttttctttttgtgttcctcctctccgccacaagctcttctctgcaggaaactggggagccacttacaatatattctgatgttatttttatttttatttttctgagctccagttcaaataattaaagttgccaccggggagggaaggcttgcagtggctttcatgtgctcacttgctgtcagacctgctcgaatccgcctcggctttgagacacccgcggatgtgtctggcattgcagccgctggtaataaagagcacggcagagtggcggctgacaccaccccagccccctgcctttcacacaccccagcagcctgaatgtctcaacaagccccgtgtggtttgaaattctattttatttgaatagcctgcctgtgactagaataatttaaaccacgttctcaggccttctgggcctgcaaggagaaaaagtggactttcctcattttctttcccctccaaggcatggaagcagtttttcttgtgtgagctacagaagtgcaatttgatccaaaaatgagatgggatccccccaatttgtggtggtcagttcctcaatgctggttttcctacctggccagagctgcagttgcgtctcccctcttctcacacatacatatgtacacgcaaacacacacacacatacacacatgcgtgcacacaccctctgggatcttgggacacagccgaacctttccacccctgacgtcacctctagcaataaaaggaatcaggttggattagctgtggggagctgctgtgatctaggcagaaggtgaccagcgggccccttccacgtctacatgggcctggagaaaaggggacccatcctttgtgtcattaaaaccagcaaatgtagcccagagggatgtgagaagacgccatggcccctggagttgaccttggccatccatccctgaagcccttctcaaaggaaggcacccgaaggcagggaatttttctgtaaattgctctctgattgattttgtaagacttttcagggtgctggtgatcatccctggaaacaggcttatccttccctccagcctctcagtgtgacgcagaagcagggaagccgagaggcaggctgtgttgattgggcttattgaagcttgcccccgacctcggcagcaggcaaataggactctgaagatgggaaaaagagaggaacttttctgactgctgtgtttttaaagtttattaaactcagtgacaaaatcttctgtggaaagtcaagaaaaggaggataagagtaagaaaacttagtatcagatggcatgagaccgaggaaaaacaaaagcagaaggggaccttcctttatcagcccccaccaaactctcgacaggagccaaagaagatgagcataactattgaattcaactcgttttccagagcagatcctatgcatcacgggctccccatccagatcatgaaattcacctcaagacccacagctaataaacacaagaccaaacctagatcttatgattctgagtttcatgctcttcctgtcacactgccctgctggagacagatggaaccttctcaacttggggagagttgatgagagcttcaaaagcatcagaactggcattactgtcacctaactcagagccccaccacctcatttctgcaggcagatagagaatcccaccccattgtgtaaacaaagagttctccccttcgtctctccacaggctgggagtagtcactgggtctaactcctgagccaccaaggggacactgccactcacctacaggactcaaatggagtttgttcattgggtgggcctcattctcggccccatgtgatccaacttactttagcaaatcaggaaggagaagccattccaggaggcctcatgggcttgattgcaaataaagttgttatttcctggagccagtttaccttctgcatagaacggatgaccatctagggagaagaatattgcacacttcccctctctgggctgactggtagaagaacaagcaagcccctatcagagcccacctgggaccagcctctctgcccatgcatggccaagcaatgctacactttgtggtgtttgtaaaacccttcttgtaaatagttggggaccagtaccaagctagagggattccagggtaatgttatctctatctccctcactaagcccaagtccctttggtcaggtatttggggaccaagatactcatcaggcagagttcctgtggatgtccaacccccatctcatctgatgctgtgacatctctgcagtgacagaatgtgcctgaattgggagaaagcaagtccagctctaggagtcagtgcttgcctaaattaagagcagatccagctagtctggctggggattgttttcacacatgctgttctctgcacacgcctcttcctgcattggagaccacggtcaggaccccaagctagcatatgatccctctaagttgtccactctctgcccaggaggacataatgttgggcctatcagaaagcacagggctcctctggctcccacagtgtaatgctgatacctagagcaagtcggagcagggtggtggctccaggtagagctgcctccctcctgccccacagcccaacagccacgccatctcctgtgaccagaagaatccagctggccatgtggggccagtgcaaaaggagcatcaccaaggcaacgtggtacagtgggaaggacagggcttgaagtcccttagcccttggaggaagcccccccactttctagcctggagaccttgagtatagcgacccactgttctcggcttcagtatcctctccagggctgtcaggagaaatgagtgagaggagatatgaaacatgcccagcctgaatctagacacaattaggtgcttaaaaatggaacctgtggtttctgctactctgttgtagccattactattattatcttcttatctgactttagtgatgattctgagaccaaggctggagcctgccttctccaaggagcctgaatctggagggtttggcctctgccctgccctgggtagcctggcaatatggcaacacccctctcccaactattgccagtggagaggggtgttgcccagctcagtggctggagtcagaggaagtttatgctttaacagcagccaagggggccctgccacccctgtccaccatctccaccagctcctctccccagccagcatgggcatgggagctccctcctccaatctgccaaaagtccctttgctccactgccccatcagcagacacctacacagaacaataaccccataccttgatatagtcccaacatgtttacagaggggccttcccccacatcgcccccatcccccagagaagatgatattgtcacctttttataaatgagagaaggctcaggagaggaacctagaccacacacagctggccagcaaggcccacagtgtcctccagatgcaagagcatctccactttccccaggggagctcctgggagtgggacagctgccgtcaacgaggtcactcaaggcagggaggaagtctggtgacacggcccagagcagaacgtcataagcctgacttttcttttacaaacccctttttttaacttaaatgtcaattctgtattttattccttaacatacctatttgtttggacacaaaaacatgcctcattatttactattgagtggctaacactccaggaagctacaccctgtttgccctgtggctttgggtacccctaggaagagctgagcagcatatgtgcccctactctaagaaacccagaggaagagctcccaccctcactgccgttttcggaagccccaaggcctccccacctttaggatctcactccatcccctaggtcacaattaggctcatagatggtgcattttgaagagcacctgctctgccttggttggccctgaagtcagcttcaactatggttgcccctcatctaccccatgagtcaccctcaccctggtgctgaaacctcaggagggctgagccctggcagctgctaacactgctggtgatggagacagtaacctcagaaagcctttagctggggtctaggcatccgcaactttgtgttagagggcaagggcctctaatacaaaggaggaagctgcagtggttctcgaggcattttccaaatggctttttccaaaggctctctacatgagtaagagatttgggccccacttccagtctctaatgacaaccgtccagacacctgtaataacatcactgtaatgagaatcccctgtgtgtcaaagcttacagagtctctccacctcccacggctaccctgtgagtggataaaatcttccctgttctgatgagcccctgagccatggcaacaaggcacttgactggctggatgcacacacggaccccgagcaagagggatgagcgagggagggacactgagggtccacagttaggtggtgaaccagcaagtattgatttcaaacctgccgtgtggccagccatgcggggagatagcccacaggaatctgggatctctttggggtgtttattctacagaaaagttaagaacacttacattcagtgtgaaaacttctggtcttcaggtcacttacaaatcacttggctgtattatgctgaaaagcaagccattattcttaatgagggccttcgaacaccctagctctttgcaccctagtagaaagaagccttcacttagtccagtgctggaggaagggacccttagtatcgataaagccaactaaggatgtagttttcaaatattgattccctagtataaggctggcactatgctaagcatttcacctacattatctcgttataaaaaattattacccccatttattgatacagaaactggagcttaaagagtttaagtgactgcccaaagtcaccctgctagaggcagagtcatgattcaaaccaggtctgcccaactccccaaccaaatctataaatactcgatttgatttagatggcctgagtttagatcccagctctgccccactgaggagccatatgacctcaagcaagtgacttcctttaatttgagaaaacaacaacaacaaaaaacctgttttagttgctgcatgaggttgttaccaggatcagaggaaaatgtgaaaagcctttgtcttctctgcaaagcttgatgaatggcagcaattattattattatgatccctcatcttacgttactcaggcatgaggaagttgctgctgcataaattcagccactgcttgtgttctgatttctcctctcagtcaatcagcaacacgtgggcaggtcgggagcgttatttcacacagtgtccacattagcaccagcaggacatgcccaataaacccacttcgttgataattaactaattaattgtgcagccccacccccaccccccacggttgcaagcataaccctcttccaggatgagagtgaacaagaagactcctcaatgagtctcgaggacccaacaaatgacaccttcctgagctttctgagccaaagtcattcttaccccagcacctagagctaggaagccactggagcccagcattctatcaccactgcctgttaagtggtcgactctgccagagcacttgctaatgcctgcagtaatcaacagcaattgtaactgcagtcagacataattaatgtaatacctttgagccattcacaactaatacctctcccattgcatgatgaagctgaggtctaggaagaatcactgtctcagcccctgggtgtgaataggatcttccttggcacttggcacagacttggttcccattcaaaagctgtatgttaatcacagacctctctggctcccactagtggtcattgcaacacattcatgtcacccatatatgggggaacaccccattgagagcacacactccctccagctatcagggaaaaatactccccagagggctctgggccccctgcagatgctcctgtgccccacatctactttttccagtggtgtccgtgaaggctgtgggagtttcattgcctagaatcatcctgttccccagcagtcagattacaaagctactcctcagtgtcatctccatcatacacagagaaactgagacacagaggaggccgtttgcccaggatcacaccatgacagtgtgactgaagaaaataccatctttttcttcccataagcctggaaagataattctctagggaacccagaagattaaaaaacagcaacaaaaaaaaaaaccagacagaaactttaacacagcattttcaccctgtcgtagtctgttttttgtgaactgtttatctctaacaaagtgtcccctgcctgctcttttccatgcaggagaaaggaactaacatttatcaaatgtcttcgctaagctgggcactggtctcatataatcttattaaagccccataataaatatctaagcagggtactgttgaccccacttgacggaagaagatgctgaagctctgagatattacgtgatacgtaaaaaatagaccattctttctgatacgaaagcttgcgttccgttcacagcacggtcccaccgcattccacagaagctcccaccttcccttgatctccctcacaaagcctagagtacaggcacaataacttgattctccctgaagtgggtaaaaacatagtactagcttttactgttttccaacatcagaatcctctctcaccacctttttaatatagcatttattgctttctctgattataaaagaactttatgttcattgtagaacattaggaaaaatgcaggaaagtatgaagaagaaaattgaaattgcccaaaatcttaccccccaaagatattggtacatttccttccagacagatagatttagatttgagctttgctatagagaaagggtttatataaatataaacatcctgtgtcttatttcttatttaacattacattttcccatatcaatattagtcttcataaacatgcttttaacagctgcacactctaaattaatttcattgtttttgttctagttatcaaaagtcagatattcattgtaaaaaaaaaaattggaaaagaaagaaaagaccacagaagaaaaaaaaaaaacttgtaactttataacctcaccagccagagatctcaaggtgattatttttgtatgtggccttcatgtttttagaaagagggcatatgaatgtccactggtgttccctggcttctacataatccctcagaaaagaaacattaagtggtattttcaggaaggatcctgatcttttaagtatcctgcaagaccaggaatccagcatttcttaagcctccataattgcaagcatttgccagaaacgtgttttatttccttgttatcaaaaatctgcatctggccagcttcttgctgtgctgggttgatttgtcattaggctatttatagctagagagttggtgtttcatttttccaggtgaactagaagatggtgaacaaaaacactggattttgcagtgagtcagtattctcagctgaagttaagaagataccacactgaaaccagggaagtcaaaattaccggttcacactgagaattacaaccctctggcaccctatattgagggagagccttaacccccatacagagatgttcctgatgacaattccaatcccagtcattcaacagagactggatggggaatacccagggagtacccccaccatgcaagctcatctttgagcatctctgttaaaaatgtgtttccttctcttgaagtgaaatacacactacagcatctagccttggttttgtctctactattggaattcatgcaggtcttcagaaatttgaagaaagatagcacctgccccgtcagaacatttcctacatttaggggtgttgcatgcagaatagatattatttgatgtcactgagtctcttttgatcactgcaggcttttgaacacacagtattttctgtgggttgaagggattgtcctgaagctgccacgaggtatgcatagcaaacatggggcatattcaagacataaaattgcaataattacctctggaggaggaatgggccatgagagaaataatagcattaggcctagccacaatgccgttccggctttacatacaggactttaattaataaaatgacaaacactggtaccacataattggaaagtctatcagtcccttccgagaggcaggaaaaaatggcccttgtgaaagcgctggctggaaccagaagatataattgctggtggcgtactcctggtgttgtctctactcacttgtctcatttgctgtctgcatataaaagagtttattagtcaaacactgccatttataacctatatctactaggatgtgtctagaaggatcaaaaattttattgttactggcatcagcaagcgttatttcccataaatataatttagaatttgtgtcagatttcgcatatttgtgtgaatacacacacaaacacacacacacacacacgactgttaattgtctggtaaggacaatggttgtaaatgcattaaaattcactagctccctaatttctccagcacgaaagtatttctaggataagatcttgttaaaatataaattctgattcagaagagctggggcaggccctgagaccctgaatttctaataagctcccaggtagcgcccacattgctgatccaaagaccacacactgagcaacaaagatctggaaaatctttgcaatatgcccccaaagctttaaggagtaccataatatattacatgggcattgcactccatgtatggtagaaagaacacagagcatagtgtggactccaggtctgcagcctgtgggcttagtgcccaggggtgactgacttaacgtctctaagccttcaattctgcatctgaaaaatgggtggaataatatctacacaaagggatgttgtcagtatacagtgagataagcctacgtgcaagcgcctagttcagcttcctggcattcagtaaagagtcaattaacaaatgacttcatatccagtaggccaggggtccccaacccccaggccaccgaccagtactgctctgtggcctattaggaaccaggccacacagcaggaggtgagtggcaggcaagtgagcaaaacttcatctgtatttacacccactcgccatccctcgcgttactgccagagctctgcctcctgtcagatcagcagtggcactagattctcatagaagtgcgagccctattgcactgatctgacattatggtgagttgtataattattccattatttattacaatgtaataataatagaaataaagtgcacgatatatgtaatgtgcttgaatcatcctgaaactaccccccaacccccagcccctggtctgtggaaaagttgtcttccacgaaactggtctctggtgtcagaaaggttgaggacctctgctgtaggccacccagatagaaataggtcttaagatggaattctaagggtgtttttggaccagaaccttgactgccaagatcaagctgggtatacttggcatgggtatttacataaaatgatatcaagggacctctaaccaaggactgtgtaagggaaatgaaggtctttgagagggacttgagcctgcagtctgctctaggaaccacatacagtgagtgctgtctaatgttagacacatgtgatcaacaaggaatactcagtaagaactgataccaggcctccaggtcttctaattaagaaattggtaaaaaccttatctgcaggtccaagagggtagttctagccccgtatacatcctcgggtcattactgctcacggggtctctctctctttttctctctctcggttattctcagtctttttctagaggcgatgtaacagccccaagaaggcccttagctgacggcagcagactccccgctgcaggaaaatcgccccctctacaccttggtgatggtgggcacattttaagccatttgtaagttattaagaattgcctcttactcaaagtccaagatgaaaatggacccctcactgagagggtcaggcacttcctgcactaagtaacccagctccccagaggtctctacccaggctgcactttagaaacacgtggagaaattttaaaatctgccgatgcccaggacctacccacatctacttaaatcagagtctctggagtggtgcccagacattagtcgtctggaaagctgattctaatttgcaccccaggttgaaaaccactggtttcaccatgtcattcacaatatcacaggagctctacttccacattcttcatctcatacttcataatccccttttgaggcaggcagggaaggggtggtggttattatcacaagtttgtctataacaaaatacaggttcagaggaggtaagtggttggcttaaggtcacacagttaatacacattggccttgaagcacagactccaaattatgccatagtcagcagacaagaaaagaggatggtttgacaagccactgaagaatgaatgttgatgcaaagggcaggtggttccagtgcattctggaaaggtcatgggatgagtcacaggagcacagggacagggatttggcatcaggccagagattctgcatttcttttttcttttcttttttttttttttttttagacacagtcttgctctattgcccaggctggagtgcagtggcaccatctcagctcactacaacctccgcctcccaggttcaagtgatttcctgcctcagcctcctgagtagctgggactacaggcacctgccaccacacctggctaatttttgtacttttagtagagacagggtttcaccatattgaccaggctggtctagaactcctgaccttgtgatctgcccacctcagcctcccaaagtgctgggattacaggcacaagccaccgcgcccagccagattctgcatttctaacaaggtcccaggtaacactgatgctaccagtctgaggaccacactctaagcaggaaaccactgactggctcttagaggcacaatgtggaagaaactacgattataactacaggtgagaagtaggccaagggacagacataggctctggactgcttgtatcttttttttcctagattcaggggataaacatgcaggtttgttacgttatgcaatagcataatgctggggtttgggcatctattgcacccatcacccaaatagtgagtttactacccagtaggtagtttttcgtccttttccccctactctcccaccttttagagtccccagtatctattgttttcttctttaagtccatgtggactcattgtttagcccccactcataagtgagcacatacggtatttgattttctgtttctacattaactcacttaagataatggcctccagctgcatccacgttgctgcaaaggacatgacttctttcttttttatggctctgtagtattccatggtatatatgtaccacattttctttatccgatgcaccattgagggacacgtaggttgattctatgactttgctattgtgaatcgtgctgcggtaaacatgtgactgcaggtgtctttatggtaaaatgatttattttcctttgggtggacacccagtggtgagatttctgagttgaatggtagttctgtttttagttctttgagaaatctccatactgttttccacagcaactgaactaatttacattccaaccaacagtgtgtaagcattctcttttctatgtatcttcaccaagatcttttctttttttaccttttaataatagccattctgactggtgtgagatggtatctcattggttttgatttgcatttctctggtggttagcgttgttgagcagtttttcatatgtgtattggctggttgtatgtcttcttttgagaagtgtctattaatgtcctttgcccagacaaagggcaaaggtgttatttttaatgaagttatttggttttttcttgatttgtttaagttccttataggttctggatattaatcccttcttggatgcatagtttgcaaatattttctcccattctgtaggctgttataaactctgtttatagtttcttttgttgtgcagaagctctttagttaggtccccattgtcaatttttgtttttgttgcatttgcttttatggtcttagtcataaattctttgcctaggccaatgtccaaaagagttattcctaggttttcttctaggatttttatagtttgatgtcttacatttcagtctttaatacatcttgaattaatttttgtatatggcgagaggtgggatccagtttcattcttctgcctatggctagccagtggactgcttatatcctgaggaagaacatctgcctggatatactcccttactgaacactcagtggatgaaaaaaaatggccaaaaaatacacatttgctagccattcactgactgccagtttgcaatcttattccaggccttttgcatctatttctagaatgagacattgttgaaactcagagagtgcatgccttggcttgagttgtggctgtagttgagtgtcttctgctataaacataggaggtatcattataagatgaaagaaggttaattctttttttttctctttgagacgaagtcttgctcttgtcccccaggctggagtgcaatgatgcaatctcggctcactgcaacctccgcctcccgggttgaagcaattctcctgcctcagcctcccaagtagctgggattacaggtgcctgccaccacacccagctaatttttgtattttcagtagaggcagggtttcaccatattggccaggctgatctcgaactcctgacctcaggtgatccacctgcctcggcctcccaaagtgctgggattacaggcgtgagccaccgcacccggccggaagttaattatttaattctcctatttgttcctagctctgaacagttgggtccagtggctgtctggacctaagtctttactgtgtgatgtcatgtgtcttgcctcgattatcttgtgtcatatgtcctgactgtcaagtggctccaattacttcaccttttgctacaatcagaacatttgtaatcattcatttaaattctatcttcctggctggatgataagctccatgagggcaggagctcatcttcaagaacagagtatgcagcaaagagtaggagtgcagtaactatctgcgagtgagtagatgatgatctcccttaaggactaatcccaggaaggatcctggtggattgcctcagaaggctaaggatgccatagccttcacaccatccctgggtggccagtccagttctctctcttttgcccggcctgattggcctaaaacacagaacaggaagatggagagagctcagctgctggctggcccctggtcccagaatagacaagacagggctgcatcttgctgacatgctcataccatcagcagactctactttaaactgtaaagttccagggagcagctgaggagggggcagtttagaatatagccaagtggctggaaagtgaggaacttctccccttccctggtccctgacccatagaatgtaagaaagtgccaaggagcttcctaggatggaaagttgattgactacctctaagaggaaagcctggcaaagatgagagtgtctccctatatagatatgcaattttattcatgctgacattgattggttcctacaacgtgcccttgcttgacagccactgtgaacataagatgaataagacagtccctgccttgaaggaattcatgaccaagggtagagagagaagacaaggcagcaggtcccaataaccttagaagatttaagaggaggaggaagtggtttctgagatggatgaaaagaaaaaggcctcctgaaaaggaaagagatctcattttttaagaagacagaaggaaaaagcaggtagagaaaacaaaagaataaaaagtatagaagcagagaaatgcaagtcaggtgcaaatctggcaagtagactggtgtaggggagtctggaacccgcattcattcagcttccttgtgtggattgctaggtgaaaactgacagactacttctctggtcactggaaggtaatgcagacagttcttcagtcacttaaaaatgcaaaacacaggctttttagtaatcagcatgctcatccagtcacaatttcaatcttgctttaaagtcatcacttcttgccctctcctgccgcctccaaacttggtcctattgcagatggaaagcctgaaatgagagaaagggtgtggtcagtggcctctctagttctccacccaacctctcctcctcttctgtcatcttgttgacttctgacttgttggggttgtaagcatagacacagaaaggatttcaggggagcaagaaagttcttattggagactgttgggtaatcttgcattggtgttctctggatgtaacaaatgtccaaggcttactgtttctcacacaggggcttttggggttcctttgtagatccacctttctcctcatcccctccaccatggcttagaatttttcgccttgacttagggcacatgcattttttttttttttttttttgagacagagtcttgctctgtcacccaggctagagtgcaatggcacaatctcggctcactgcaacctctgcctcccaggttcaagggattctcctgcctcagcctcagcctcctgagtagctgggactacaggtacctgccaccacacctggctaatttttgtatttttagtagagtcggggtttcaccatgtttgccaggctggtctcaaacttctgacctcaagtgatccacctgactcggcctcccagagtggtgggattacaggtgtgagccaccgtgcccggccaggtatgtgcatctctattataggtggtcacttccaccttcctccactcttgggcatctcaagataccggcagcttcttcctactattgtctatttacctccctcttaggcaagatctacagtgaccctgcatgggctcccctatacatggttctcctcccacccatatgcaacactcatgcatttctgccccagcaaactctgggagtgtaggccacccgatgctgccaccttgccttgttctgccatcagagcagctagccagcccctagttcaaactttagaccttccaggtaggagacagacactaatccaccgtgtttccaaaactgcaggggtaagtatcaagtccttgatatggtatcataaaaccattctctcttgacttgagatgaagatggaacacccttcccaccttcttcttagcaggagagtgaaatggaactcgtggtatgccaaaagcaccttccaaaaactctctcctaatagtcaacctccagcattttgtaatatgcaaagtatgagtgaagggttaagaattatgtcattcatttttatccacctctcttgaaagttctgcaaccttgtgctcttacacttccctttgaaatgcagcacccactgcctccatgcttcagccaaaatgcctttttaatattttgttacatcaattattatttcagttaacagtccctataaccctataagagataaaactattctcatcttagagaataggaaactgagcttcaaaatgattaaataactaggccaaagtggtaaaaacaggttttgaattcagaactctctgattctagaggtcttagaccattctgaaatggagaattcatgtgacccagcataagtgcttaacaaatatttgttgaatgatgaaaaagttgatttcctcagataatagaggaatgtaaatgccataatttttgacagggcatgagaaaccatcgacagttgttgagcccaagtcacagatgagcatgatcaacaggagaatgtgatagaaatatacaagagaattcggaagagagaaagagtggagagggagaggcactttaggagactctgaagagttcaaagagttataaaggacatgggtactctattttgctagagtaatgaggagattatctagaaaccaggttgaaagaacttaaagagagaatgagcaacaagtaactagcggcagcagttacatcccagctgttcaagatgtgagcatctgaatggggcaaagaaatggttacaagccagaggagcccagaggatgaaataaaggatatttctccagaatgggtgaaccttgatcttatttgtagacaaaggagccaaaagattgactctgagatgctggggaaaggagggaaaggagggcagtaactaaaagagcaaggactgggggagagaaaatgagctgggctaacgtggaagacagtgaaggatgcagcttcctctaagagagaaaaggaaaagaaaggaggataaataaacactgggcccacaaaaaagagagaaggggactgaaggagattgttcctgacatagtagatcttctcagtaaagtagaaatcaaatcagtggattaggaggtgggaaccagggggtgagagtgtcagtatgcgagggagagtttgaaacacccattgtactatgtgtgtctggaaatcaactgtggaaatcaagagagaatgaacaagtaccacctcacatccagggcattgagactcaacagtctgaattcatggaagttcaaattagcagtattcttcagccaaggagcaaaaggagaaagcatcgtgatcccaagctaggcactgcatggcatgggctgagagctgaaagggtttacagttagcaggggtagagttgaaatttccaatcatggcttgtacaagaaagctaagtgaggccagaaaaaaaaattaacagattcattcatttatcctaggaggtctcagtagagatgcatatttgctacccaggatatggagaaatgggaaaggtgtaagtgaagtgtctgtggttatagaccaggcttacaaggtccagggactcagaagtaaatcagtccctgggggccccaatgccctggtgtgaccttattagtgaagggtttgtatgcaagaaagtgggaagtttggggctgccgtgagtcatggttcttaacctcttcaatcaaattgtgaggcaaccatgtatcaaggactggaagacaaaggagtggtaatttacaaagaagcaggtattcagagagaatcagtaaaaagggggtacctttactctgacgaaactgccagtttaccataagacatattttacctttctttctacaataaccaccattttttcttacaggattattttaggcaatgatatgatatagttgtcctaggtttttaaacacaaagaccagaaaccttgtttatagtatgtcctacctctgaatatgatcgtacttaaactttcttacaaaggttattagttacaattttctttcaaatgtttaggaacaatgccacagaaacttttaataaagacacaatgaaaaacacagttgtaacttccttttggcgaagtgggcatcctcttcgaaagatgcccatattaaaagatcttgatatgtagatttttgtctggcctttgcctgccagtggccacaggtgtcaagtcattgggtctttagttagctgacatgtgacatgacaccattcaaatgagattattagagtctttggggaagagagaaaaatctatgatacctaaatcactaaaagaaactgagtcacaaaatcatttgtccaaggtcacaaagtaaattggggccacaggcaagaatctttggctactctttaggaagttcatttactaccccattgatcttgatatcaccttacaggcagaatcttgtgaaaggtaggatgataacatcaacctgaacaaagttccaaaactgcccatcagttgtccctgcccaagaaaaaaaattaacagattcgttcagttatcctaggaaatgggatacttgaacttcactgaaagcctcttggtgagacaggtggtgggcatccagctcttctcaccaggctgaactcagctgagtctcttataaggtccttgaaacttcagtggagaattccagaaaggggacctttcagcaatcataccttgtcctctgactcttctcgccctcacagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggtaggctctatgcatctcccccaatacccttctcctctatcagctaaaatgaaaaagaaatcatgccttccctttccccgtgccttttacccaagacacacatgcagatgtgcccacacaccgatatgtgcgcgtgcacgcacgtgcacacacacacacacacactctgcaggttacacactttctgcagtttacaagcttctccaagggatgaagaggctactgaacacttgtctcgggaccactggtatggcctggttggctacccccagtgtctggaggaaaaataaaattgaacaactcacatttcccccaaataacagtttggttttacatgtatatagcatgttctcttatatgatagactttgccttactttccccacttttattttatccttattaacaagaaaacctgcaaggtaggtaggacaggccttatcatcatttaccactcctgtcctgttataaggggagaaacagaatcaaaacggtgaagtgccagcaagttggaatcggaattgggactggtgcccaggcccgactccgagtccagtgttctctgttgagtcaggtcctgaggcaggttgataaagaggatggcaaattcttcagtaaacagaggaatgcttctacttgtggtcttagttcctatttgggctctatcactaatggcctctgtgactttgagcaacatccttgacttctttgggcctcagtttcctcacctttaagctgagaggtttgaactagaaaatcattaactccacgtggctctgcaatggagcaggaaccatggagtgttcactgccacttgtctcccaggatggcactattctgccacctgcagtcagcctggagcaagccgtacttgaataaagatggccctgcatggcagcactcatgtgaccctgccgtatcatcctgaaccctcatggtgggtgctgatctgttccagacaaaagaggggcgaggggccatttctataaaggggacagataaatggatctggatgggggacagccatcttttatgggctaaaagtcaacccttacaacccacagcagcctctgcctgagactcctaaaacacaatcaaattaccatcctggtggatccaccttcaaaaaatgaggacagagggctcaaggcaaggtggagggtgatgctagttggcatgcagctttataagtgtaaagctggtttcacatttttcgcccaaaccccacagtctgctatgtccaagagctcataactgcatcagtgctgtcaaaggacaaaggcattgtcctcactctgagcactagctacccactccttcagatgtgtgtgggttaacgatcaaagcccaaggacattccaaggatcagtgaccccaggacaaatggatttaagtggagaaaggaggaagtgtgagctctgcccactatagtttagtcttttgtctttggggattgtggagctgcatgcagttggtggagaacaggagggtggtgaaagaatcctccctcctgggagaggtgaaattaattcagatgaatcaaagtgttttttttctcctcaatccagcaagtcttctctctttcatagctactccaggggatttaaagtaagatgttgactcggttcactctcatcctctagagtttcatttgaaggagacttcgttctcagcctccttcttccctgttaaaggctgtttaccagactaacatttccagtattgatactgagaccaaactgtccagtggggattccgacaaaagacagcttggtttgatgatgccttgtgacctaataagtgtacaattacagaaaacaagagtgcttccattcgctgggagcctgcataccactgacatgctctgaggttggaagctgccctcccagaggtacagatgatatgggaagcatcaagatccagaggcaaatggtactgaaggaaaatgaagtgcagcagttttcattcgctaaaatcaaactagactgtagatgtgactggccccaaagaaaccaaagaagcactctagatgaaagggcagaggctttggaatcaaatagtgccaagtttgaaaactgccatggtcacttactagttgtgtgacctcagccaattacttaagctctctgagcctcagtgtcctcatcagtaaaatgagaataataacagtataatttcacaagattgttatgagactaaatgaaatgactattgaaagagtctacacagagtattaatagattttattttctgcatctttcagttatttggcctcagtaataatttattaaacaaatagcacaaatcacaaccactgatcttccaagtcaagccatgttctataaaacagacaacacagtctcctcttaggtttggagaagtaaagtgcttgtttaactgcctgatccacactaaatgctcaactactaataactatagtataataatgacaatatctccccacctaatggctcagaagggtctgggatggccaatttagcaatataaccagtcatccaacccttagataaaggcgggcttcttatgaatttgttttcacaatgctctgttgactccttatgagaagtcactgatggaggagcaaaaagcattctcttccctcttccttcagggagagtcagctatagctgcccagattgctagaagatgaaaatgggagaaaggagaaggtagaggaagacataagcaaggaaaatagaaaaataggatggataaaagacaaagaaaaaccaactctcttcctcccacctctgaggtaggcggtaacacctggcgccacctgccccacatcccatgaagcttccttaggcagctcctggcttcagctattcagcacctactttgtggacagctccccaaccctgaaccttgaaagcggcagaaattttattccctatgctgtcccaaatcacctctgctcccaggttcctcaaccttcacacattacaaaatttttaaagtaactttattagggcttagaggttagcacttaagagactccaggctctagtcaacggtattggaaatctgaccattttcctattttggaaatccttctgtggcttcctgtggctttggggatgcctttaaaactccctaataagaccttttttaagcccatgtgtgatctgtccagcgctagtttcaccagctgcttcttaaaccattctttctctctcaatctccccttccttccactcagttgtaccatgctacattcttacttctaggcttttgcagttgccatgttaaaggcatgttaaagttaaaggaagaacttaatgttctgcctttactttccatctctctaaatactactcttccttcacttaaaaaaaattatccccagacacctatactctatatgtacccacaatatattctcatggctcttgaaacatccctataataatttatcactctttattatcttttttatatctgaatatacaaactaacaaggtagggattgtgtgtgtcttataaatcactgcttcctgaatctttagtaccatacttaacatgtagtatgcccaataaatatgcattgacagaatgatgtattgagggaaattgcatatactttcaaattccagttgaataaactgagaatttcacttgatggaatctatctaacattcctcctctcttcaacctgtgtccgacaaaacagatatgattgctttataataaatactactgcaaagtgttctgtatatcagagcaacacctgtgtcccatcagatgaaccaaaacagcatttgttactctgtgacaaggaattatctttagggacttgcctggtacctgtgctttctttgtctctggtcacattcctgttggaatcacttcataagaaagactttgatcctaattgggtgccctggtccttgtgatagagagaactagagttgtgcacttgagagaaaagggctctagtcagattgcccccaccacacagtagtcctcgggaaggctcggtgaataagtcataggtacataaagcctggtgacagggaggcattgatccatggaatgatatttcttctgtccacttacaaacatgtaaagcgatagaaggaatgtaatagtctgtcatcattacagaattatgttaactgtacaaccatagtataatgagtaacaggaaaaatctctaagagcaatgcctaagatgttttgagcagtggcaatgtcctctgaatacagataaatgctctcaaggtaattttgaaggacaacaccaattcaaatatcagcttgatgtgtgcttaaaaattatctcattactttacatccacctcacatagctacttttcctcatcctctccccactttatcagccccacctccctcattcaattgctgctctttctgctggaattaattctaccttttctcaaaatagaagaaaggcaagttctctctcctgattctaattgtcagtctcttgcagagatatacccctagtttttcctctctctatatatcttactaaattaaacacaatgttcccacactatcctaagctttgacacgcttacagagcagaagccatgctaagttcaactcgttatgagatggatttggaaacaccatggatcaaatcatgtcccacaaatcactgcaattgtacagtcaaatataaagtacacaacttatcacacctgtgcaggctccattcctcagcactatcattataaaggcttttagccgtacactacatacatagtctaacaagaaaaattgttccttctggagatatttagatttcctgttccctttgcaatcctttgtcctaaacgacaagtggtgtgtttcaccaatgcatctttcaaatgagatgggttaaactgagagttatgtcttcatgcatttagaccagaaactccatagagccaagattttttttctattcaatttttatcaccgacagaattctcattttatgtgggatgctgtcaataacaacactctccctttgtgtagcatctttctgtgatgagaaaggcattgaagagcgtcttttattacttgttcttatctgtgtagagaaatagtagatttcagtgagtggaaatccagagatttccggtaagcctcagtttgcaggtctagacacacccctaaaaaaattctgcttaattcacatttctgttaattgaatcacagcatcctgataaagccatttaagagttataaatgatgattagagctagcgtttgttgagtgcttactgcctgccagtcatgtaacaagtacttaacatgcattatctaatttcatccttaaaacaaccccttggggtagatattataattaatcccctttttaatatgagaaatctgagggctatggaggttaaataattttcccttaaactttaggctggtctgcctcctatgtactgcctgaggaagtgatgcatggggcttggcatgtagcagaaacttgaaaaacagtagccattgttgttgttttttaattttttaatttaatttttagagacaaggcctcactctgtcacccaggctggagtgcagtggcatgatcacagctcactgcagtgtcaaactcctgagctcaagcaatcctcctgccacagcctccctagtagctagaactacaggcgtgcaccaccatgcccagctaattaaaaaaaaaaattgtacagacagggtcttgctatgttgcctaggctgatcttgaactcctggcctcaagtgatcctcttgcctgggcctcccaaactgctgggataacaggcaggagccatcgcacctggtcaatagccattgttactaacaaaatatttaggttcttggttatttttaggccacatctcttatccatttcacattagtttactgctttccctttgcttcaaccagctcctgaaattcatcctagcaattcccaccaccacctcctgctgcagaccattccccgcacggcccctgcctgcctgcctctcctctcaggctcacagctggagtctccccttatccttccaggccattgtgtcccctctccaggtgcctcccactccggcatgcctttgactatccccacaccatgtgtttcctccccagcactggagcacagtctctgataggcatttttaatttgcatatctattcatgtaccaagtctaaccaaggcataaaaataacctttagttatactgtacatttaacaaatcgccctttcattgagaataaagttcactgctgtaaggatcaacaggagaccccagccacaaggttggtacactgtgctaaatagagccctgcttcatctttaggagcacatggcccaggggtgccccccacatctgctcttgtcctcctgcctgtctgcccctcctaggagcattttcatctgtaactgctccgcctctaactccacctcaggaaaaagggatgcctatgaggaggagcagacatcactcgcctactgaccctctgctggacaagctggctgacagtcccagcagctcctgcgcctcctcactctgcccacatctccccatccacggcagccctgtgcccccttccagggtgcttggctccttcacaacacaaggttctcactcaggctcgcatctgagcagctagggtagatgtcattccctaatttcagctgaaaagacagaggcccagaggggtttaagaacttgccattaaacatagaggcccctctgtggaggtccttcctcccctcctttcacttcacgagacagcatcctgtgaaggtttccaagcatgaaatgtacaaacctccaaaatcccctgaggcattatgtccaccaacatttactgcagtgttgggtgccaggtgatgggcacacccagacaagcaatacagccccagctctcaatctccatctaattagggaggctggcgggaagacaagaccacggcatcacagaacacgagtcctgggagctggagcagaaggagcccagtaaagccccagctgttggggctccttgcttcccaacaggcacctgtctggttgccagtggtgagtcctccctctgctgggcattcccacacgaatagaagcagagagcaatgactaccaccccaggtagacatgcatttgctcatccactctcagcagacacatgccaggaacttaccccagagtagacctgcaggctccaaagttggaaatggggcagaagggagaggaatgtctcacctgcctctcgcgaggggagttgaattgccctgatgccatatatatatatacacttaggcaaaaccgattcgttcacatggtgagtgaagaaaataaaaggtgctctctactcatgacctgctgtggcagcacaagtgtcccttcccgaagctacaggggctggggacattgacatgcttattggcattaggctgagtcagttctttgaactgggagaaaatggtggtctcagaggcaattataagccatgcagggtaaattacattgactaaacccatcaagtctttccccaaggggttcaaaacacttcaagtgcacaccatgctttattctccttaccttgatgataagggacgtgggagcagagtccctggcttcatcagcagcctgcaaggctgaggggactttggcagggctggggtcccacctggagcccatggcctgtgcctcttggggccataatgatcgaggacaggagaagagggatggcattctcactgaaccaagcatctgtgcccgtttatcttcatcattataagtcagattttaatgaccttagtttatcaatgagaaactgtgactcagagtagtttaaataatctgtccagaggcacacaactaagaagcagaagagtcaggattcaaaacacaattttcttttatttatttatttatttatttatttatttatttatttatttatttttttgagaaggagtctccctctgtcgcccaggctggagtgcagtggcaccatctcagctcattgcaacctccacctcctgggttcaagcgattctcctgcctcagcctcccaagtagctgggcttacaggcatccaccaccacgcctggctaatttttgtattttttagtagagatgggatttcaccatgttggccaggcttgtcttgaactcctgagctcaagtgatctgcccgcctcagcctcccaaagtgctgggattacaggcatgagccaccgcacccagttcaaggcacagttttctagctcaaacactcacccttttccaaacaccatgctttcatggtcaaaaaattttttccatgaatctcagtgacaacaggcagcaggtgttatcacacatcagcagctgatatgaaagaactgtgctatggcgcctaggcctgggccacctgaagaccctgtcagccgtgaagaggtcagcctgtacctgcagggcccagccatgcagttaagagccaaagaaaggactctgacttgtaggagcacaccaggcacagactggggtgccagatcagtcatccagagagggatatgggtgtgtggtcaggacccaagtgaaaaaccaggacaagacgaggccccaggcctccagaacatgacagaaacccggtcaatgagcctaaagcctatgcaaatagcacattagcacaggagagctgcatctgcatcccgagccctgggccaagctcctttatgccccctgccctactcagacctgtccctagtcctggagtagtgcaggagtgtgctgcagaggggaaggctatagctgtgaaggaagaatactgcagattcctgcagccagtcaaggaccaagttcacccatccctcccacccccatgagtgtgttagtcatcaacccaacaatgccaggtgcactgaacacacctgagtacctaggtatgtgccacatgtatgtgagagggggtgacactacctgaagtaacattacatctccactccaggagctgtaaacaaaagaaatgttatttcctgctcgtgtgaaattaaaaataagcatgctggttggtgggtggccttccacctgatcattcagggatccaggccccttccacccttttccttccctgaatggaaaggattccaaggccagagaaaagggtgggcctttcctctggccttggaatcctttccattcagccagtcggtgggcaaagagcttaggaagccttgaacaggaagatttttatgaatcatcacttctgctccgctcacattgcctcctttgccatctgctctctttggatttccttactgactttttgtttgccttatctgggctggtttttatgcttcgtacctaggaaacaaaaattttcagtcattgggattttttttcagggttagaattaccacactacctgtaatatcatactgtggcttctgtatcatcatttaaggtttctgtctaaaattggcacatgtaagaatcaaagaaaatggttacataattcagttgaaggtcttggtcattagatgttaggcatctattgtgtgtaagacacaaggccaacagtaacgcagaatgatgttgacctgttaagtattctttgaaacatggcctaaatgtattttattatgagctcatttttgactattgtaaatattagtggtttacaatgtgctttcgtcgtatttcctaaaaattcaagcagtgagaaataagactcctctgaatttagtaactcaaaactgataacattaaatgtgacttggaaaaactctagaatacatggtgcacacaagaagcgttcaaggttctgtggatgagtttcttagcttttgcaatgcaccatgtttctcaaagcttgttttcattaataaaacattttataatgtaaaaaaagtcacatggccacacctactgcaaagggtgctggggaatgtagtctagctgtgtgcccaaataaaagaagtgagttagatttgaaaaaaaaaaaaaaatgagatggtgtgtcacagactaagtcaaggaatatagctctcatgtctggccatctatcagagtgtcacttgagaatgtctcttcttcatttagctatgctgagcattgatcacgcttcttctccacaaagcctcataactcaaggctgaaatcaattccaggttctattctaaggtatgaatgtttcattcccaaatttttatgatgcagcaaaatcttactttctggcagaaaccacctcagaatttccccccacccccgaatttgtcatttctaaaaacaaaaaataaataaataaacaagagaaagtgcttttgaaaaggcttaaaactagcaggacagtgtaggacgatggtttccaaacttggatgaacattatgatcacctggaaaacgtatttttttctttcagagccccagatctcatacacaaagattctgattcacagatgacatattgggaccaggaatctgtattttttaaagttccccagttgactttcatgcgtaaccacatttggaagtcactggtatataatggcagatccaggtatctggatctgggcaagacagggaatcaagaagtgactggagaaatgtcattggctgacacattgtcggcaaacatatattaagcctccatcaagcacagaggatggaaaaggatgtttgatcagctcttgccagatcacaggacctccacaggcaaacagtagcacacaggcaccctgcaggttccaacagatcatgaccagggttcagcaggtgcattgacgtccagatacaggagcagtcagatgaaccatcacggagaaaatgagctttttataaactggtgcttgaggaaaatttaagtcttagagaaatggaaaagggacaaggcattccagagaaggccttcagggaaagcagaggcttggagatgcagaaatgttttttgtgggttcaagaacagccaacctggttgtgtcagagaatcctgagaaatctttttgggagagagtgagtgtgaatattaggccaggtgttttggatttaggaatacaggtaataaacagccactgaaggccaggtgcggtggctcataactgtaatcccagcactttgggaggccaaggcaggcagatcacttgaggtcaggagttcaagaccagcctggccaacatggtaaaaccccgtctttactaaaaatacaaaaattaactggacatggtggcatgcacctgtaattccagttccttgggaggctgaggctggagaatcacttgaacctgggaggcggagattgcagggagctgaaatcgcaccactgcattccagcctgggcgacagaaagagactccattccaaaaaaaaaaagagccactgagggccaggcaccatggctcacacctgtaaacccagcactttgggaggccaaagtgggcagaacacttgaggccagaagctcaagacatatgttggctcctggccaacatagtgaaaccccatctctactaaaaatataaaaaattagctgggcaaggtggcgtacctgtaatcccagctactcgggaagctaaggcacaagaattgaacctggaaagtggaggttgcagtaagccaagatcacaccactgcactccagcctgggtggcagagctagactctgtctcaaaaaagaagaaaaaataagaaagccactgagcacggagataggctggagggcgggaagcacagagcatgggggatattggaaggtcttttgaggggcccagtggcaagtgattggagcctcagtgtgaagctcagaaagcgtgaagaaagaacctggaggagaagaaccttcttcctctgctgtcttccaaatggcaccactggctcaggacagccttgggcgaacttaagtagacatgggctacttaaaattattaagtgaacttaattaggtttgtcaatccctaaggttggcagggtagcaaataaggcaatatattcactgtccatcgacagcctgttgcctgaacgagattgtgcattttctgagctgtacgtgagcagcttcagccgttcaagaagaggagaagagatgcggccggtggctcagcacacgatgtgcaaccaggcattgatatatagaaatcaaacattcataattctggaaggatctggccctgtttctttctcagaaaatatcccagatcattggagcaaggagtagattagcaattctgagctttaaatcttatttctaacgctgatttactgtgacgtttgggacaagttgttgcttttgattgctaagtttccacaatcaagagtgcaaagcagtgagacagatccggcccatgagcttggtttaggaggcagttgctcaaaatggcactaagtgaacctctttaaaataacaggatgttcgaatctgctcaagattttcttggtaacatccacagcttggcttacaagtcaacagatgtgtatgtttttcataattcttaatgtctcggaaaatgtagccctgtgttctcagccccttctttccctaaacacaaagcctgcaatttaggagataattgagcttccaatatttgaagcaaagaatccagttctatctatgctgcccccacccccgcgccaggaacctcatcaatgctcataacttccacccttacctctatgcagatgactcaaatatctttatgtccacctgggttccacacctgggtttccagctgcctgactggtgtcccacccacaccttccacattgctcccaccagcacaccccactgcctagtgagagtttcgcccatagttctaccattctccaagacttttcattattttaagtctttcttgacttctctctcattgtccagatgcaatgtttttccagcttgagtagcttctagctctatagggggcacaactaaaagagacttcagcaattcccggtcagtaaataacgtgaatcacatcactgactgaaatcctcgggagcaaggtccacgtcttacacatctctacactcctagctataggcacaagtatgtgatttacagtacctgcgcagataatctctgctcaaagaaagagggggagagatgtcatttgtggcactgcttgaggaagcacatgttactagtaaacatataatataaaacaggagcaataaattagcatctcatgctaaacaaagggttccattgttgggggaaaaaaacacatcttacatagattcttttaaaaaccaagatggcaccttaaaagttttggcaacttgcccagggccccaccaactatatagacccagtcttcactccactctactttttgaaactagtcctcaccaagcagaaaagacttctaatttactctcataaagatgcttttggtcaggcgagaagagaggtagaaaccaccctttttctgggtcttctcgccattgtcagtgctgccatctcggtaccatgtcagctccccaagccgcaagccaacacagcaacagaggacagaggaaatgtttgtgtgttccaagaaacggggagcagacatccctgtccctccaagaagaatggatggcgggcctttctagctccagacagccctcatgcccccagtcatcccaaggagcttgctctacttttccgatggtacggagtacatatgagactaaatgagattcgacaagttggatggttctgcaagagatgatgggaaaattggccagggatgcaagaggcctgagctctcatcccacatccgctactatctccattgcaaccacacaagtcaaaagaatggcaggggcccaagaggcacttgaatccttccctagggcacttggcatttgactgtaggtcgagtatttttgtgcacaggcccctcgcttgctggaccatggctccaggaagcaatgtctttcctcatcaaaacccagggcccagcagagctcaacatacactacacagatttcgagaatgaaagaaaaacaggaacttgccagagatgggtctccatctgctgtggtggaacatccttgcagcaggcctttccagttggtgacacaccagagcacaggagggagccaggagcctttaggctgagcccccgaaagtgagcacagaatgcctggaagcctcaaactgagaatgtggaagggtctgagtgattctccatgcttgctcagcctggctgaaaattcattttctctcttatttctagaagggcttcctcaccaagccagactcattgtgaaagatctctatggcccttgaaagccctggaagctctgtgttgacttttactcatgctcctggtgtcgttatgcctagaggggaaaccaaggcaggaggtggtaaattacttctaagagtgggatggagccaggaggggtatgttcccaactcctgagtatggccttgaatgtccagctcatctccagtttactgtgcagaagttaaagactcctagagccaagacacacattcctagccatgattgcgtttgacatggccaaggatggtcccaggaatccaaagcggtccatcagctcccatcttcatcttagagctgaagtccattatacagataataggagggatgtggcagggctttttcttcacatatattattctaatagatatgcctactgcgacccaagcttcatgacagcccattttagaagacttttgcagagcaaattaactgtgcagcgagaaattggagaaagtgtttttcctctacagtacctgccagctctatcctaagcagccagggcccagacaagcaccagcagcaaaaagggatgcaggacactcccttcttccgagcccactaaatggccaaggaaggaatgtgagacatggtgcccagctggcaaatgccttctacccagtccagccactccatcctgctctgccctccaaagcttcgccattccctccatccacatcagacacaaacctttctgtcagctacttaaaatcattaagtgaacttaattaggtttgtcaatccctaaggctggcagggtggcaaataaggcattatattcgctgtccattaacagtctgttgcctgaatgagatggtacattttctgagtcgtacgtgagcagcatcggcatttctcaggcagagatctgcccgatgagtctccgaggcgcccaattctgaagctgcccttccagacttggcccactgcccagatggccacctcccagatccccgctgagtctgttttcaaaaggcgtctctgtagagctgaatgagaagagtcagggcgaatgcattctttatgcaaagccagcctccaaccaagatctctagccaagtctgttttaataacaagttccaaactccaccggctggaaaaaagaaaagaaaaagcaacaacaacccatgcaatcaaaagtgtcctctttgaagaaacagaaagagctgagcaggtacgaactatgaagggtcaggagcaaaatctctgctgctaagcactgggaaagagaggagactcccctgccacgttcttaggcaacacagattggtgagagagtggaaggaaccccaaagggctaacgcttcccttctccttgaccaggctgcccacagagaggaaggggaagcctcttctatcctggggaacccagcctcctttccccatccagagctgaggtttcaaagtggggcagaggagtaactatgttctctaggatggcctgtccctcgcagtcttggcagtgatgtgtcagggtccttgctttctttcagccaaacccagggtggctcatctggtatatgtcagaaccttccctcagtcccagagtggtctacatgccagaactttccttcaatcctagaatggaccacctggtacatactagaacttttcctcagtcccacagtggtctacctggtacatgccagaacttttcttcaatcccagaatggatcacctggtacatactagaactttccctcggtccgagagtggttcacctggtacataccagaaccttccctcagtcccagagtggtacacctggcatatgccacaacctcccctcagtcccagagtggtccacctggtacataccagaaccttccctcagtcccagagtggtatacctggcacataccataacctcccctcagtcccagagtggtctacttggtaaacactagaattttctccctcagtccaagagggtccacctgatacatgccagaactttccctcaatcccagaatggaccacctggtacatactagaactttcccttggtcccagagtgggctacctggtacattctagaactttccctcagtcccagagtggtccacctggtacatactagaactttccctgaatcccagagtggtccatctgtatataccacaacctcccctcagtcccacagtgttctacctggtacatactagaactttccgtcagtcccagaatggaccacctggtacatactagaactaacccccggtcccagagtggtccaccgggtacattctagaactttcctcccatcccagagtggtccacctggtacataccagaaccttccctcagtcccagagtggtacacctggcatataccataacctcccctcagtcccagagtggtctacatggtacatactaaaactttcactcaatcccagaatggactacctggtagacactaaaacgttccctcagtcccagagtagtccatctgtatataccataacctcccctcagtcccagagtggtctacatggtacatactagaactttccctcagtcccagagtgggccacctcatacatgatagaactttcccacagccccacagcagtccacctggtacatgccaggactcttgctcagtcccagagtgtgtcaggtcccaactaagtgtcaggtctacctggtatataacagaattttccctcagtcccttggtagtctacctggtacataccagaactttcccttagtcccagagtggtctacctgatacataccagaactttccctcagtcccatggtggtccacctggtacatgccagaactttccctcaatcccaaagtggcccagctagtaagtggtagaactccagacctgaggccatagctgactctggagagtgacatggtagctgtacttctgggggactcacggaaaggagtgggtagaaccaggagactgcgagagccttgaggaagcctttcccatctccagcaaggagacagtaagcggtgccagaagcaacctcttcttcacctatcaggtaaagacacacaaccaggcaccttcgaaagtagggaaacctgaatctgggtggtcctgatgcccactctgtctctgggccagcacatccacagaaaagagcctcctagattggtgctgctctacctgctgactgcccatcacctaccacccacagaccccattcctagacggcctctgctcctgccccaccctccacccatccttcagcagctcacctttgtcccacctttgtcccactgtcccttccctgcagcctctgggggctggagccatgggggagggttggcccatggatggacagaggcacccatgtgtgggtggccccgggtggacagaggcagcactgcctggttccatattgccatctgattgaatcttcctgatggttgtgcgtgttcctgactcaaaatatgtgcaattcacagtgtcaatcaaactcttttaagcagcagctgccactgctgtcgccgcgcagagcactttagaaactcttctatttagaaaccattccagcctcagccggcatcatcccatccatgctaagaggcccagtggctgtgagagacttcgcagatctaatctcttagtaataaggaaggaaggcacagagaggggcagggagacatgcagcttcccagggagcacccatttagaggatagccgcgattctgtccccccccccaggcacacacatgtcatttactcgctcaagcccctctggcctcctggaaggtacacccctcatatagctcagcattgaaaccagggcctggcttggcccctggtcctgtgaatgacagattaggagatgatgacctggtggagaaatgtgccctgtgggggcactcaccccctgatgtgcaggcgagccaggcagctgtgccttcctgatgctcccacagggaacctgagtccttctattcaccctctctgtcactctaagtgcctgttttcttgctacctggaagcagcattttcctaagggttgcacctgctttaacaagacagcagtattagggccctggttttccagttgagatcccaggcttgggctttgtccagggttacagaggctcaagccagaaactcatctatggactgtttcccatggggagaccccacggaaatcgtggctataaccttgccaagatttgtagagaaacctgatgaaggcgtgtgagatgtgtgcagaaatgcctctcatgctgtctcccctgcctctgcctcctctcctggtccccatcctgcttactactcccatcacaattatcctctaagaggtctttgatcttgccactgtcctgttagaaacctccagtggctctccattttccctgaaataatggcagaacctccttgcctgatctctgttcagaggtccacaccatctttacctccttcctcactccttgctccccagcaggacaggtcctatccctgcccacatggccctcacaccagttcctctgctccagacatctcctccctgcactgcactcccacacccacatcctcaagcccttccctgcattcaaaaccaacttaaatactgtcttctctgtgaagccctcctgctctccccaccctggtgtaattcccccttcctctgagctcgcacactgctgtatctgcacctttatgaagcattgacctccttctactttattccacaccaaggtacacacacttcatcttcacactggacaataagtaacttgaatgcagcgttcatgtcgatttctcttagaatgccccatagacctatatgtaatagctttacaggaaacaaaaataggtgtgtatcaaggttggaatgagagatgcctctcagaggcatacaccccagtgccagagtggcaggggctgagggtccttgtgctgtccatcccctcttgcacactcatctggcatgcccaagccacccagaacaggatttgaaggttctccatcaggcacttctccttccacacccaaccaccagcacacactatcctgactgagggtagcatggagacttcttcatggggaatatggcctgaagggccaaccccagtgatgctggccacggctacaacagatttgggcatttcttctttagaatcaaaccagatttgggtcctgtaattgtgactttcagacagaaaggattgtttctgaatgaccagatctcacaagatggttgaaagcacagataaatgtatggagtagttcagttaagcataatcgatcacagttattcggataaaagttttgggattcaaggctttgctccatggaaacagtaattgttctctggccaggaataaccaagccagcatctaacaagccagcatcttctacacgttgatcagagatcatctgcacacaggcgcaacgggagcttccaacccctgctgtagtttacccactggctaaagctttgctgcctcactgcaaatccatatgagcaaatgccctttctttccatatctcttcctctgcatctttcctcccactgttgacatcccatttcttgtccttgttgtaccctgcaggccctgttctctccatgttgccagtgccaccctgctctggttttctgctcttgacaccctatgtggccaatgccctgtggcctgggttccctctctcttcctctctctcctttttttctaacacctttatcagactgtaatttatatatcataaaatgcacccactttaagtgtacaagtcagtgacttccaacagatttatagagctgtggagagagcaccacaatcccgtttctgagcattttcatcaccccaaaaaaagcctaggtgctagtctgcggtcaatcctgtgcccactcccagccccagacaaccactaatctgctttctggccccacagatttaccttttctagacattttctatcaatggaatcattcaataggcggtctttcacctactgtctggcttctttaacttagcatcacgtctttgaggtccatccattttatagcacgtctccgggtccatttttgaccattgactggcgtcccatcatatggctgtaccatatggagtttgcccagtcaccaatggatgggtatgacttctttctcttggtgttttcatacccatgccagagaccacgccctgttctgcatgtcattctggattgacgttctggagggtaggaaaggattttaaggttctcaggaaaccttcacttagagcaggaaagggccagctgactctgctagccttccatgggatgatttcccaggaaacaaacaaaccaaaagtactttcctgtttatgtcactgtaaggccttccctggccacagtctgagaacctggccctccaaggatatgaaagggtgggggaaagaaacaatatcttaatgggtttgttgttaacacttttatgacccctgtgttggttacaacacttccaggggtgatagtcaagtcgcttaatatttaaccaccaggcaggcaacctccagtgatgctggatgaaacccaggatgcttgagacccctgctgggctaatcaatggataaaccctatgggtgctggttaattgggaaattgaggggtcggggcagcagggaaggagccagttgcctgaagcaacaagcaaggggaactggtggaactgtggttctttattggctggtacagaagcattttaatattttaataatgacttaagccccactggctgaatgtcagacctacccatttctcctgttcagttcacccaaacaggacacccaagctggtatttttttccccaactcagtgccttgaaatcactccccgtttactgaacgaagcagttactgtcagatttcttcccatttccaagcatcctgcacacccagaaagcaaaagatttctcctcagattatcagggagtcctggtcccaggccccaaactccaggctggatttaaggaccagtgtgtcagccattaacagtacggagcgatagttcggaaggggaagtgctctgcattgcagaagtagggggagctgactgctcttctctcgccactgctctgggattagcgagcctttttcaaactcacattctgagccaggtgatcagcacacacctgctggatgctgaatcctaagacaagaccccccagtttgctcctcacacacattcctcttgatgtgtacaggttctggctgcagatggtcgcatggtggggacaaggatccagagccatcgtggcttttgacaatatctccatcagcctggactgctacctcaccagtgagttcactctgaccccagcactctgtcccccaacccccatggcccatggcctcattgtcccctcctcagcctaagcctgactgtctctcccacctccctcagtgtgaaatcatctctcaccctgaaatcaaccctcacctaactcagcccgtggggtcttctctattgcagttagcggagaggacaagatcctgcagaatacagcacccaaatcaagaaacctgtttgagagaaacccaaacaaggagctgaaacccggggaaaattcaccaagacagacccccatctttgaccctacaggtaagggttcagctcacaaatgtgagcacagtaacttcttgttgcaaaaggcagaagaaagattggtgctgtctttagggtggggagctgtgctgaaagaatgaaacagtctttagaaggagtatcacctacactctgactatggggtccaaggggaagctgtctggttctcatattgcctgagcaaaggaaacctctggaggttgtacaaaggagcagcttcctctatgcctagggaatacctaggccccacccaaaggagagaaccaagctggcatttttttccccaactctgctttgaattcactgccgccttactgaacaaagcaaagcttactgtaagatttctcctccttataaagagggctgggcctggccaaggttatctgttgcacaaaggtaggctaccccatcatgggtaaagcccccaaagcttcctttcaacacagttcccccagagctcagatccctccaaagctgttctattcagcataccccaagccaagacttctcatggccccttgccacttcagcagaactcgtcagcctctggttataaaccacaggtgtgacttctccaccactcttctattagaccagcggctgtgaacctagccccgcagaagctgactaaggctgccccagccccatgccagccagccaagggattttcccaggcaggcactggtgcctgggcctgtgaggtgtcttctgctatgtatagcctggagaaacaagtgtacaacacacagtctacccacactctttttcctataaaagataagtctttatcaaaataataacagatcaatgataaatctctaatttcaacttataatgtgaaatccttttttggcacaaagtacaaaaaatgaggtccatacctttgccacatctgctctcaacatgtgaactagacattagcatggctttgtctttgaaggagtcctttcctttctgtcccatgaaaagctgccccagggctaaccgtcaccccttcctgattcctgcctgatctaatccagctgccagacccaggagaaagagttagttacttttcgcatcatccctcccttcccctttaactagaaccatgaaagacctttgtatattcccacacagaggggagcccgtcctacaaaactgcagctctctctgctttccccctcacctcccagttcatgccaatgtctcacctgatagaggcagccttctaacttctccattcagtgccctaccccccaggcccagtgattcacctccactctctccttggctcttggtcaactaccacctccctgttataaattcaggaaatgtataaatttataaatggagggaagaagccagacttccccttttagtgtgctaagtaaacatagccatagccccctgcccagcctaatcaacagcactgattacacagcagagactccagaaacatctattgactagtgggtggctggatgcctgagcttggatctcaggtgtcagcagccagccccctgcagccagcatttaggaaacagccatccaccctgctcaactcctgagtttattgccacataactcccactgtccctaaaaggttactcagtaagggcctgcccaatggccactcagactaatgaaatcaccagtggctcacacgtggcgatgactcccccaccacctctaaataaaattacaggctggaggagacagcagctggaacacaagtctccccactgagaaacttgacccctcattctcaaccccagtctcagagcaatactgaggtagtgcctatgggtccaggcagactcatggaggcagaggccaaggccacacccagtcagtaataatcacccagcagacacgtgcccagcacggtgcatggttacaacagggacagggctgagccaattcttgccattctggagcttctgggccatgggaggagagtggcctacgaggcagcagggcatgtttgcaaagcccaagctcagagcttctacctgggaggccccctgaagaaggacagagggataggccagagggggaaggaaaggaaaggaaagatcatagagcgtggtcccatagcctaggttatttcacacaacagcttgtcctcacacaggcccagggacagttgctgtttttaccattatagggatgagtaaaatggtatggaagaatttaagggccccaaggctggaaggcagtagggccaggaagtcaacctggagtccacattctttcacccaactaagctacttctaggtatcaaagtctccaatcggagataaacactaaaaatggaaaagagcagggaagagttccagccaagaggccctgaacgaacagtaaacaaatcagctcccaaccttctgacaaacaatcgaggagacaggataataagatttttctttccaaagttcaaagctgtcagtttctgctgggctggaacgaggtggttggtggcatttcaactctcctccgggcaggctttagagaactagaaacgcaaaggccctttggggtcttttgagaacagttactgacaacacttctaagcttccctaaacattcctcactccccacagcagccctcccttctgatgagggactcagcctgactccttggatctgggaggttcttcacctccaggcccatggagcagagctgagccgctcaagtttccaggctgggaaaatcctgtccaggtgcttcatgcagcattctcggaagactctgagtcactttagctaatcagatgaagatgctgaaagagaaaatggggcaagtattaagtccagggaaattacatttgtcagctttgcacatacaattacactaaccaaatgattggggtaatgtgaccacggggctgcagagccaggttcttctctctctctctctctctctctctccctcacccgactccctccttctctctctctctctttctatctctttcccctccctgtgactgtctctctctggcagtaatgaatgttagcagtgaggaggaacagtcaggctctgccacactctttccctaaaaagcccagattgggacaagcaggccccccagggcccaaggacccttcctcaacctccctacccctctatccttctccttggagctcagaggctgtctgtgcagggcgagtctaagggaatcagctcagctaatgggagaacccgcccaaactttgggcccaactccacaaccctaactatggagccttggcatcaaaaccacagccttgcctctagctatttggtgagaggtaggtctgccattttctgcatacacatctctcgccaaaggggggataaaagcaattaaaactatatagtgtcatgggaaaagcactggactaaaagagagaacacccccactgggccctggctggttgcactggcaagccgtgggcgtggggccattctgcctctgcaggtcctcccatcggggcaagtctgcagatgaggggggttaatgtgaacacagacaagggcagagagactgcaattttttaaaaaatcaaggttagaagtagacagtgtccaagtcccttcccgtttccagctccaagattccaagggttgaagggcgataccatcagggagccatggctttatttggcccatatctccaattaacccatggcactgctaatgtgcccagaagtgagggtgacaggctgtccactttcacacacgctcctgattcaagaacagatgccaattccaatgagaaagttttatatgtttcatataaattgattgggtctatttctgctaaatgcattatccattcaccacagaacaactattagagttaatagaatttgtagctagagccattatgttccaagtacgcccttctggggatgacggcatccttggaaggcaggctccacaggcctgcatcctccctcagaccctgtctttccactcgataggggtctttgttcccctcagagcctgctgcactcaggcccggcaggtccggccaagcctacttcagtagcacaccccaatagaggaggcctcttcccttcagagtcactccgttcctgaatcaataatgtattctaatccagttccgaaaaatcctggcctcttccttgctagccctgcagaaaatcccatgctggggacagggaggaagccaagttcctctctttagccacagctcatcattgcatcccagccttgaaggtgggaggtccaagatgtgagaagtccagagacaagtcagagcaggaagcaggaagttccctctggagggaactcagatagactcttgtgttaatggcatcattaacagctttccccagaaatccccagttacagacgcaatccaggactcacaagtgcagcagtgagctggccagccaaggaactagattcagccccaggtttctccaagtgtgtcctcaaatcatcagcatctgggtcccctggtgtctgcaagtgctgcttgttaaaaatgcagattcttgggcccctgtcaacctatggaatccgaatgtctgggagcaggaagtcaaaatccacatttttaaccatccctcaaggaaagtttgattagcaaaaaagtttaggaacccgggactgcatcctgacctacagacaaggagcctggcccaaagcaaaggctttgcatcacattccctcttcacgcagcaatcctaactgcgattcaccaagcactgctgtgtgccaggactgtgctgagctcttggtgctatcatagtatccccctttaacagatgaggtccagagaggtgaactaacttgcactaagttagacaacttgtgtaaaaggcaaatgatcatgtttcttaaaaatcatgcagaaagtgaaaatttctaagccagataacatttagaaggtcaaagttgtgataaagaaatcttttaggaatcccattattgaataggtcttcgagagggatctctctttcattactgaatagatcttcaagagggatctctctttcattattgaataggtcttcgagagggatctctctttcattactgaataggtcttcaagagggatctctctttcattactgaataggtcttccagagggatctggcttcttatgttagttttcgtttcaacagagcacatctgcatcttcactaacattcaagacggtgccccaggcaggcagtgttcccacgcacatgtaagaaagctgataattgcagctaattggcattcctccatgctccccagccttcactggtgcacttggaaggcacttctgttagcacccattcagctggggggggactgttcattaaggggtggcaggcatgggaccgtagttagaacccttggagccgcttgagacactggtcatttccctgctcagctgccctgctgattaacctcatgctctgtgttcttgcttattttagattatctcgctaattttagattatcacctatttatagcaagcacactagtgatgacgcaggaagtaccagccttaacaaggctcttgggaccccagtcatcgcagcacgttcggcgccctcccaattagaatgtcactattcatttgggtgtgtctcccttccctggagcaagcacagctgtgctccaggaagagaggtggcaaagaactaatttgtgattcatgatcccattaccaacgctaatgagtctcttccagtggaagaggctttcacgctggagagccagtcagcatccccaagaggtggacatcagtgaacaccagggttggcttgatggtgagaaagcacttctccagggacctggtgacggtgacagggtggaactggaggctgggctgaaggccaagcacccatcagcaatagagcttcccagagtgtgttccgccatttgtcagccacctccttccatctgaacacagggtgacagtcactaagctcattcagtgtctctttcatttgattctcacagactccctgagggagatgtcactatcaggaagcaatatagcatcttttttaagagcacagactacctgtgtccaaaccccagctatgccactcactctaagcacctcccttctgctgtctgtgcctttgtttccttgcatcaaaaaatggtgcttagattatcaatgcttacagcgcttaggtttgatgcaaggatcacatacgtttatatgtatccagggcttagagaggtgcctgacacatacggagctacctgagccatcattttcttcccattttacaattgaggaaacagaggatcagaaagattatgtgacttgacccactaatcaaatgcagggccagggttcaaagtcaagccggctcaatccaaagtctttccaactctaagcccatgcctgttaggaacaatactaaatactgcccaattgctgaccagcataagggagaagctcttgctgcatccaaatcagctgttttctttccactcgggagattcaactcagcgcccaatgcagacaacatcattgctttccctgaatcccaagcctagggactaacaactcatatagttcaatttaacaagcatgtactgggtgcctgctctgtgccaaaccctatgcaggggcctggggctctgaggctgtgaacgagccaaagtgttctcttgaaaaatgattacccaaagcttcgtctgcataagcccagtatgaagccactactatcccagcacaagagagacttctgattctgatcacctctagaaccaggacaggtgccctcacttgaccttgccctagatggtgcattgcaaattattctgaactaatcatcattttcaaaatgtgtcctgtgagatagaaaggcatcaacactattatttcagaacttcccaaactcaggccctccttaagaaatagcacagactcacccagctctgacagactcaaagatgcctcatgaacctccagtctaatgctaggtgggggttggaattatggcaaagctgctgacaaaatgcttccacataaagtcgatactgttgcccttctaagcagcagacaggaaccattgcctttctctctcctggctggcctgagaaaacatgttgttttttctcatttgtttcagtgaaagcttgcataagtgagagacaataaatgatccaggaactctgggctcagtatgccttgattaagatcatttagcttgaagactaacagaacacaaaggcccctccatcagggcaagtgcattaagtacttgtttgggaagactgcttttttatcattcttctctcagacttgctgcttctgcctgtaaaacagctctgcatcttctcagagcctatttagctctctgcttgttgcagcaaagcttcagtggttttggacaaagaaaaacattttttttaattcatccgggcctggaggtggacagtgaatctaggagtaaaaaggttaaaatgctaactcttgatcacaaaaggtggtcttcccagcttgcccctctcctattgagaggaaaagaaacaagaggtggaattgccttagctatcatggagtcagggaggagagagagggcacagggcagaactcagcccagccagtgccctccctgctgggtgcttacacaaaagatgaggaggccaaagtgtgtaccagctgtgcagcaggggatttggggtgcctggatagttatctattgtgttgtaacaaatgaccgtaaacacagtggctataacaacacacatttattataccagtttctgcaggtcaggaaatcagacacagctcaactgggtcctccacttcatagtctctcgtaaggttgcagttagggtgtcagccaggactggggtctcatctgaaagctctactggggaagggttcactgccaaactcatatggtggttggcagttcttggagggttactggactgagggcctcacttcctaactggctggaggccaaccttggtttctccccagtatggcagcttacttttttaaagctagtgtggggacgagggggtggggtggggagagagagagagagagagtcttctagtaatacagaaattataattttataagcaagaaaacgacatctcaccatctgtgccatattctgttggttagaagcaattcacagatctcacctatactcaaagggaggaggttacacaagggtgtgattatcagaagctggagaccactgaggccatcttagagcctgcctgtagtggcttctccatgctggagacgaacattcaccaggaagctctgggagcccagtggggattctgatgggcagaattcctaggatcaatctcaagactatgtattcaatattctacagatgcttaaatagtcacgaagcacctactgagtgccaggcaatagcaagacagtaagtgaattggcatagaatcccagagaccaaggttctggccatgcaacttcaggagagtcaaagattctgggccccgtttcctcatccatcaagtagggatattaattacctgccacagttctttctcagagctggctattgtactgagcaaatgagatcatttctatcaggctttcaaaggtacaaaacaatatgctgatataaaatgctgttgtgacattgtaattaacattattattaaatatatatgtaagcaaaaagatgggccaattcactcacccctcatgtgttgccttctataaatattcagtgcatttacagtccacctccttctatgagttgtgcacacttttgtgtatacacgaaattctatgagctgcacactcttatgtatacacataaatatgtatctggaggggaggttaatatcttgaattttgtgtcctctcattcagtaaattcccccaacctaattgctcatcagttttcaggtaaagccctcaaactccccttgggggaaataaatgatttgtgtggggtatagaggattgcccgaaaaatcctctcatccgtagaatttaaaagaggatctttagtcttctaaagcttatcaagatcttgaaaacaatggatgcgtcaaaaccttgttcacgaaaattcttttaaacaaatttgaagtgattaaattggagatgctttgtttgtttgttttggggtttttgttttgttttgttttgttttttgagatggagtttcgctcttgtcacccaggctggagtgcagtgccgtgatcttggctcactgcaacctccacctcctgggttcaagcaattctgcctcagcctcccaagtagctgggattacaggcacctgccaccacacccagctaatttttgcatttttagtagagacggggtttcaccatgttggccaggctggtcttgaacttctgacctcaggtgatccactcgcctaggcctcccaaagtgctgagattacaggcatgagccaccacgcccagctctgatttgtttttatggtgaatattaacagtgtcttcataataagataagagcaaattgtagtcatctaatttttattattttttagtaagtgattggcagatctaacaatgatcatattctaggaaaaatgttaaaaagaaagaaaacaaggcttagtgtgtggttgtccagcaacctaactgagaatcagaaaaactccctgagcgtcaaaatagtttcctggaaaagaggactatttctttcccctcagctggctttatgatcgtgatcctactaactagaccattcagtctaccagccaatccatttcgtcagacatgggattaggggagtggccacgctgctaaggagtaggactcacgtgttttcttaaaaacacagggctcggccaggcacagtggctcatgcctgtaatcccagcactttgggaagccaaggtgggcagatcacttgaggtccggagttcaagaccagcctggccaacatggtgaaaccctgtctctacagaaatacaaaaattagccggtgtggtggtatgtgcctgtaatctcagctacttgagaggccaaggcacgagaatcacttgaacccaggaagcagaggttgcagtgagctaagatctcaccactgtactccagcctgggtgacagggcaagactctgtctcaaaaaagaaacaacaacaacaaaaaaaaaacagggcaccctgcattttggatatgtgtatgcatgcatgtatgagtgtgggctggtgtgcgcaattgtgtgtgttcgagtgagtatgtgagagtgtgcgccagctcctcagaagcccaaccccttccaatcatgcgtaagagacaaaacaaaatggctttcagcaaacgtccacttacactaacaaaaccactctggtttgtccatcttaaacattctaacactaaaacaggagccccaaagggccaaaagtgtcccagcacccactcactgtacccctggcatgcatgaccacctccttctgaccactcaggtgggtttggagatggcatttgggctactctgttgtttctatttcattttgctttggttttgtttttcacataacaaagatttattaaccaccctctctgtgactagtgctgttttaggccctggacacaaagcagtgaacaaaacagacaagccctactcttatggagtatatgtgctagtgcagaaagcaaactagtgtatagacagcatcatttcaaagtgatatgccgtgaaaatagtaaagcaggtcaaggggacaggggtggtggtggccaagcacacatgtgtgtgaatgtgggccctaacaatgaagtatcgagggaaaaaaacttcaggttccttcaaggacgtgggagcagaatcaggaaaatgctactggctactaatattaagatgctacttcttactctaggctggtgtggcctagggaaatcttcaaggccttccacaacatccttgcaacacccaaagctctgaaggccttgacggtgaagtgcactgagacacagcagagggtgggtggagtaggggagcatgccttggctgaccagactgggccgggggagtgaccagggtgcctggctcttcatcgaagaagtcaggcagaaggccacgtgcagtcaactctgaagaagcacgaaaaagttggttccaatccaggctggcattgctgtttgagagacagcagcaggattctctgttcagtggtgtttcattgcaagtagctgggagatcttgattctaggaggctccattgaggttgaagtaggatccagccaatggctgggagcccaaggattagtccagtcctacaacaaaaactattttatagatgactgctgatgttaattcagtggccctagaagtgactactgtcattatccagtgcctgataatgtcaagactcacatctctgagatcctcttggccttttcttcatgcttgttgcctcatggttacaaaatggctgctgcaactccagccaccatgactgcattgcagacaaaaataggaggggaagcatcccttcccttcttttctctagtcctctagtcttacacactttgccttctcttcttggtctagtatttggtcctaatgcttccccactgctttcttttctgcccctgaaatttggatctcatatcttctcatatgcgtctcagtcctccaatttattttagaggatctgggacctagacccagaagtcgggacacctttctagctccaaatccccaagccagttgggctgcctgcacctccgtctgctcatctgtcggaagtgttacaattccaagggccttgtagagatttcagtcatcatgagttagaaccaaacaatgagcaggaatgacttagaatagagtgaggggctggggcttcccacacgtttgcctctctcttagatgctagtgaaccttacaacaggaggccgcaagtcctaatcacataacccctatggtgatgcactagattaaatctctcctatccgcagacaagaatggacaaggcagaagtccatgaccctttgggcttgagtgtggcagagctggtatttaaaccaccaaccacttcccacttaagcctcaaaaccaaatccattatgcgtaacctgcagatggctgagtccacagcacccatgtgatatcaaacactttattggccccactctggcccgaagccaagttagaaataaccaaattagccctgaggcctcccttaacttaatttttacagctctgctttcagggtagtgtttttcctgtgacctttctcttctcccttgtgttcctgactttcccttggggagcagggggtggctgcgaacacaatacagcagccatcacaggagccattaaaatctcctgcagatcactgggtgtcagagctgcttagggcaattcagccctgaaagcagcttttatctagacagccccagcttgctgccctgttgatgggggcaagctcactcggaagtccctctccaagaaggggtgtctgccttccgcagggagggagatgggcctctggtctttgttccatgggatacttcagcattatcaggcactctgcctgtctagagaaactgtgtctggagcaaggaaacaacagtgtaacagtaaaaatgagatcatgtgtgtgagcatttctagtaaaagacagggctggtgtgatcattgttgttgttaccacccctaacttctcatcatacacaaagaaccacagagaaagctttgcctgaatgaacggggtgggtgtgtatacacaggcacacatgggcaggcgctcacaggtgcacatgcaagcatatgtgcatgtatgtgtataagcacacacatgtgtgtacctgtgcatgcacatacacgcaaataaattcggtctgagaaacaagctggaagaacagcatggaaaattcatcaactgaaaacagttcgtgttgtagaaagagggaaggtgatgtgcccctcctcacttagccccaggtttactttgcaatcactggccaattgcttaacttttctacatgattgcatgacttatgagacaaaagtcacagttcttctcccttccctatctactgacctatcgtggttgtaaggagctaggcttactggaggagaaatgtaccataaattgtccattgaaattgaaggcctcaacattctcaaccctgttcattcagaatcatgataccatccttttatctgaagttagacttccaataccttccaccatccaccaaatataaatgccaaaatataaatacgttccaaaactgtgacataaagattttctgcagttaactgccccttagcctgatacatgaagaggggtagggccactctcatgccctcacctgatcttagaggtaaagtaagattaaacacgggtggacatgctgcagtaccgagagacacctgccagcagagacagagtcactataaaatatttatgcctgaggccatttagtgaagagtcaaatagccctaaacaactcattaagtctgggaagcactatcaagaaaaggttaaattatacttagtgagctgtatcgaaaataggcagagcataatgaaacggcaggttctagaccatggtcattggagatgtccctgaggtgaaatctgaaaaaacaaacctgcagcccaggaagagaaatgcaggtgagggctctgaccagataaatggcatacaggggctcaccatagcaaatgagctcaaatgatttctacatttaaaaaatgtttctaggattctgggaagagggcagtgatggtggtaacagcatagttttttttttttaatctttccaaatccctacataagcacagaacacccatatatcaaaactgaaaacccatgaacaatattgacagcaaaatttgaaaataaggcattcccctaaaacttcaaaatgcaagtgagataggtcaaagcaccaacaaccacaagacctgcatggtatcagcatctgtacaagatataagacaggaaagaaacaggcctgagaacaggagaacccctaagtagccaagagatagttgctagaaattacagaaagccagtctgagagcagcttctgaaagtgggagcggctttgcccagtgcaggggaccaggagtaccacagtcagatctgaaggcgctggagcagcctggccagcaaacgtcattgcaggaaagggcccacttggagaagaaagttctggggataaaatcaatattgagtaggaaagggataatagagaataaataagagaatgtccagataaaagtgaaggaaagaaacagtcagaaacctcagaaagcaaactgcgtttttttgttgttgtttttttttttgttttgttttgtttttgaggcagagtctccctctgtcacccaagctggagtgcagtggcatgatctgagctcgctgcaacctcagcctcctggcttcaggtgattcacctgcctcagcctcccaagtagctgggacataggcacccaccaccatacctggctaatatttgtattttcagtagagacggttttaccacgttggccagtctggtcttgaactcctgacctcaggtgatccacctgcctcagcctcccaaagtgctgggattacaggcatgagtcaccacacctggccaaactgccatatttttgaacactgtattaaaaaaaggagtagagggagttctgtgaaataaaaaagctcctgaaccctaaaaatccaggaaaactaatctcacataaaaatacataacagaagagcatcaagatcaaatatcattcaaaattaaaataagaaaacaaaaacaggatacagagggcggaataacacgcctacagaaagcaaaatcatgccagaaagacgtgcttattggatgagtcagaatctaaccttctgttttaaaatgagctaaaagacacaaaaacaataatacaagacatgaaaaataacgtaagtcattgtaagaaaaacagaaatgtggtgctagaactcagcaaagaatttgcaataaaagaaaaactattttcaaaaatgaaggctaatctattaagggaaggaacaaaaagccaacaaacacaacagtttatgccttataagaaatagaagttaaaaagaggaaattttttaaaatgaaaaagatgacacacatcaaagactctattttcttgttatataaagtgttgctgtcaaaaactctgataattctaaatttccttctctaataagtcatttgctattttgcttaggtgcccaaagtatttttttctttttattttaaagtccggcaactttactagaatatacatgaagatccaacatagaaataattgaaagacctgacgaagaaaaccgaataactagaacaaaacaaaatacttaaaagtataactccaggaaaatatccttattgaagctacttgttaaaagagcacactgtatacctaagaatattaacccagaatgagcggtaccaatgtgtattctagtaaaattgctggactttaaatagaaagaaaaaaattactttggacacctaagcaaaatagcaagtgacttattagagaaggaaatttaaaattatcagtttttgacagcaacactttatataacaagaaaatgagtagcatctttaagatactctagggaaaaatatattatcaacactcaaataattcaaggaatatttctccagtgacccctctctaaggaatttactttaaaacaagcttcggacaacgaaaatgactacagaaatagcaacataatgactggtgtgagcaataaatataaatacttacagaactatgacgaagtaagggataaagaggaaagagaagcatatgtaatggctatctgcccggggcagctatgtgtagtacagtacacaaaatcacaggagaatggaaagaacatatacaaaaaaaagttgaatgctctcaatttttatattaattatggtggtagtagtaaagattgtgactctaatactgtgtgtaaggagaggtaaagtaaatgaataattacaatatattctaattcaactatcacatgtgtttctgagagacatggttctcagtgtgaaaaaagaaatgcagatatgatatacacgaggttaaataaaaagtcctgtcgtcctgaatttgagttggaaatatcaatatgaactcatgatgtaccttgtgatatacatatgtatgtgtatttcatatagatgtatgtttatactgatatacatatatgcatgcacatatatatttcctagctctgttcactcaaaaaaatagacaatcaccaacccagtagcaaaaagcttccatagcacccagaatatgtacttaaaataccttttcctactaagagaaatcagggcttttgaggaaacggttgattccaggtctggagaagaagtattttgtcatatcatatagcaaagaagctttaaaagtctactagcgtcatgtcaaaaggacctgggaggctaccactgaccaaagacgtgatcatttgagctttcagagaatagtaattgtgaataattaaaactgaaaaatatgtttaaattcatggattcataataatgtacaaacagttaattggccagcttcagaggatgatagagaaccaattcagtatcttgaaatgtatacataaggagaaataattcagcatttattctgcattttctacatgaaccatattactcagtaacccaaatagtagattgggggaacatctttttataaatatattccaactaatgtatgaggaaagaggtaaataagtagaataacattattttgcaacttgcaataaataaatggttctaagcattgagctttgtttgataagtgctaacatgataaaagagagcaataatcagacacaaagtatctcctgatgaaagaacatgacctgtagtcttgcaaaaggatctagttggcaatttgcaggacagagaacatgttgaactgccccatggagaaggagtcagcaaaattcagaatctgggaaatgctgcagtcaaatagcccagtttcttcaaaacgagaaaatatggaggccaggcgtgatggcttttgcctgtaatgacaccactttgggaggccatggatcacttgagcccatgagttcaagaccagcctgggtaatatagtgagacctcatctctacagaaaatttaaaatttagctgagcatggtggcatgtgcctgtggtcccagctactctggagtctgaggtggtaggatcgcttgagcccaggagatggaggttgcagtgagccaagatcatgctactgtactccagcctcggtgatagagcaagactatgtctcaaaaagaaatggatgaattattatatttgcctggattttggtcatgatttttatttactgggacctagggtgcccatcaaaatggctctgtatgccacagcatccatggcatttagttcagtcagtggatgtggatgaaattcaatgctatggatctgaataaaaattgtacaaatgatccacatgaagcattgagcgctcttccgtggtacaatacacacaggcctccaaactgaggcagatccttactgttgtgattaatagtgacgatcgagaactttcctttgtattatgctttatttctttgcattgaattcagcagatgagattgtttagcaacagtaataaaaccaggacaatcattgtctagcctattttttttttagcgatgtactgtttattactaattgatttgtttcttcttggagggtgctacaatgtgcttaaaatgaaacccagtgcttaatagacttttctgtactcaactgtctataaccaatcagtattttgatatttgtgggttctttatacagtttagatatgaatgagtattaaactatgttttcagtatggggtatgtgtaagaatgagataaggcagttctttttttttttctttcataaatgagtattaatagaataggtttgtttgtttgagagaagaggaaagaggcaggtgacgtccctcctctgccccccatcccagatcctccctggggaccatttgatcatcctacagctccatagggcttcagagaccaaggcagaccctcagcaggggagatatggggacctttagattgtctgctcagcatcaagccagcctcactgctagtctcactgtgaccttgatcttctctccaaaaactgggatttttgtcctgttgcttatgacacagtctctctctgcttcctgaccttataaacactccagttactaggtttcccttatgacactgccttgctcccatgtcctctctggggaccagagcctcaacctgagcaccttctctcattggctgacacctttgatcctgcacagcccatgctccactaggctaagcgactgcgggggccactgcaggactttctgggatggagggtccactcacctcagtatagtgaccatactctcacctgtcccctcatagtggcctgcctactctttgggcctgagcaaccttcatatggtctgtcctggctagaactgagccccaggctcagggatttcaaaagaaaaaaaaaaaacactcaaaagtgttccctagagatttcctggggagctgagccccttttcaagccttgaacttggactcagaagatctacatttagttcctggctagaccagttatctacttcgtatgctgcagaccagccactcaactcctctgaacttgaatgtcctgatttttggagggaacactgtaactccactcgcagcactacaaagttgcagcaagcataacggcatttcctgcatgtgtgaaagcgcagtgactggcctatattaggtgcacagtaaacactgagaggttttcaccccttttgtgagtggagattacctctcaggtgcctgaggtgcagcctcccaccccaactccttacccaggaagaaggacaaaacaagtcaggaagcacacagcttctacctggggatcaaggctcaccttgactcctcctgtcccctggaaccactcttgctaactctcttgcctctctggttttagacctgctcactttgatccacaaagtggtgcccattgccttccacttcagcaacacttttgaaaatcaacctagcatctgcctgtcttctcatggttctgactcaacctgtcttagcgtagagctgatctcatgtctaccctacctgaagtacctgccagattcttcctgcttgaagcaagagcctaccccttgggcaaggatgtggaaataattagagtctgtccccagcaagcctcagtccagtgcacagctaagagaggtcaatagtgtatggagcagcttcagagagacactatagataaaacagaataacaagagtccccttatgcaaagtcacaggtacccacagctctggtgggtcaatcatgaaaatcagactctggtattaagtaaggttctgaaaaagacaaggtgggtccgggacttatgtagggacaatctgacaaggcttggaagtcttcaaggcagaaatctgggaacggtttaatcacccccaaaggacccttggaccgagaaggaggaaccctcaattttggttccttctccaatactgataggctcagaaaagtcacttctccctaaaatgctgtttctccacctggacaatgaggtgcagaagactaatgtacaagtctcatcgagtattagattctcttgagaatgctttttaaatgtttcaagtattgccttctcatccccacccaggatctactaaatttgaatctccaggtccctagaatctgtatgtgaaaggtcctcaggtggtttggaaaacactgaattcagagattgccaaggtcccactgtgctgtgacattctctgatgactacaggattgcagacagtatgaacaaagggaaccagcagatgaagctggagcagcccacacatgagaagcaggacagccctcgcacaatgagcaatacactcagaaactccacacccccagaggcagtgctggtgggaatcataaattgattccaagcaactctgggcagatttatgagggtcagagccatccaaggcagcgaggaccaccatgccttgaaggctgctgggagcaacagaattctggcaagataaatcatgggtctgacacaggatggcaaatcctctcttcccacagaatccactttagaaagcgttccctctctaggcccatccgtctgaaatcactgaaaatcaaaacaaaattttgtgtatggaaaccactggagactaatgtatgtccactgaattgggaaagtacaggtcccttttattgagaaatgaccctggagtccctcctttatgaaatggaggacataaattttgagattggatatctgcttcccacagtgaaaacttgaatgcaaagttacacacgttttaaactgtagtcattgtgcatctctaatgctgaatgttgtactaagcactttgcctaggtcatcgtctaattctcacagaaagtctaggtggtatgtcttacagtctccaattgttcacattttaaaaactgaggcttagagaggttgtacaatctaccttatgtctcacagctggccagcagagacatccagaatgagaacacagcctatctgaatccaaagcctaagcccttcttcctccctcaccagatgtctcaccttgccagaagtagaagcccagcatctctgggaatatttcagaaccctcagaataaactaacctaggctgaagtggttcccactgaaggtgagatgctcaggtagtgtgccaagcccatacctttagatgtcttccctagcactctattgagaagaatacacacacacacatatatgtattcatatatatatatagagagagagagagaatatgtattcatatatgtattagtccattctcatgctgctaataaagacatgcctgagactggctaatttataaaggaaagaggtttaactgactcacagttcagcatggctggagaggcctcaggaaacttacacttatggcagaaggggaagcaaacatgttcttcacatgatggcaggaaggagaagaatgagtgcccagtgaagggggaagccccttacaaagccatcggatcttgtgagaactaactcactatcatgagaacaggatggggaaaacttaccccatgattcaattatctccatctggtccctcccatgacacatgggaattatgggaactacaattcaagatgagatttcggtggggacacagccaaaccacagctatctacctatctatctatctatctatctatctatctatctatctatctatctatctaatatagatatatgtattctttcattttcagggttgaattaactaaataaactgccacgcttctgccctgtgattgataaggccacccccacacccaggctgcttgctgtaaggaaagcctgggtctgcagaacaggtttcaaggaactatagataaggagaggagtggatttcacaacttcttttctggggttttatttttctccctgcccccatccctcctccccaacccactgactttaaattcccaggtgctgttggcacgggatccatattcacagcaactcccctggccacatgtcctgctgtccaggacagcaccagccttgggtacaggcaggagtcaaggacacactcacatgtttagagtttgggacttagcagcgaaatttcctacccctttgcttcttttaatatgtcaatccagcctcttttacagacaaaggaactagatcaagatcccctaatcaataaatgatgaagctgcccccaaaccctggtgttcatgctgatttcaaagcctgtgttctttccacatcacccctcgtgtggtgacgtagcacagcccacacatatattttgggcacaggagtgagtaaaagggcagctggtcaaactagctctgccaaaaatgcattctataaagagtctgaattagcaggtttgccctctttataataaaaatagaggatgggcatggtaattcatgcccataatcccagtattttgggaggctgaggcaggaggatcgcttgagctcaggacttcaagactgcagtgagctatgattgtgtctctgcactccagcctgggtgagagagtgagacccccatctcaacaaaaagttttaaaaattagctgggcttggtggggtaggtctgtagtcccagctactcaggaggctaaggcaggaagattgtttcagcccagaaattcgaggctgcaggaagccatgattgtaccactaccctcagcctgagcaagagtgagaccctgtgtctaaaaaaaaataaataaaaaatcaggaaactaacaatcagccattcacacccaaagtgaatggctccattaccttctagcccctgaaatgaccatcctgaaaccaaatagaaataaacatcttcctttgcaaaaaataaataaataaataaataaatgaagcccagaaaagtgttgaggactccgtgctgagtagcatatgcattagaaccccacccagaacttccacctcccagcctctgggccagggcagcatgacaaaaacccacgacaactggcccagttttcagattagcaaccctgcccatggcagtctcaatctattgcttataatcggcaacccaagttaacctttcacatttacgtaattaaattagtgcagtcttcaaaatgttttcactttaatgtcttagcaaaattatgcatgcccaaattaatgtttccatcattttccttagactagaacttaatctctcttttaagggaatttctgcaatcttatgagatttttgtattttaagtaaaagtagtttatcaacaacacctttttaaaagtttttataggttgtaaaaatgttagaattttggccaacatgagatctgacaactccccaaggtttggtctggctcaaagatagaaagtttgaaaggaaatggcccgcggggggtgggggggtgcagtttgtgctgagtgttcctgtgttgcccccagaaagccacctagggacgttgggtgggacacagaacaccaggaatgggtgagggggagctgggaaaaggaggagcatgcaccaaagacaaagttgacctgtttttccattttttatactctgttgcttggagagcctgaaagctgtcttcgttgcatttccaaatgcaagctggttttaataaggagcctgagccctgccttgctgcaggtctgttagggagcgtctgacaggcaggccaagccatggccagggagtgcagggcttcctgctcccaccaccagcctgggtccctgagccaatgtagcatcaccgagctttcaattctctttttcaattgtctccaagctaagaggctcctataggcaatgctgagcctttgggagcaggttagttgcagtcaactatagcacagattgagcacctgttgtttgcccagcaccgtgctaggctcggtgagagactgggagaggacccagctactgcctacgcctgtcccacctgcaggggccttctccccttcctggaactcccctagcgcagtgttggctgggccctcctgtggcttgctattcttgctgtcctggcctccctttgggtctctcatagtagcctgtaagctgcttaaggccagggtccatcttaagtctgccccatctttgtctctgactcagggtctggcacatagtaggctttctgtggaagtttccagttcgatggctgattggtgtttcttgccctgaccttggtgccatcttggatggagggtttggggccatggagcagatatctcagaggccacccagggaggcccctggaggagggagggcctggccacatgagtgactgcctctcctcttgtgccacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacaggtgcgtatggaagagggggaggggaggggcagaccaccccttccgaagaagcctggagtcttgcctatgggtgcatgttcctggggtgcccaggcatgtcaaggttcaaaggcaacagactcaggcccatagggggtataaaggttggagatggggagatttgggagagtgaaatatggcaacaaaagaagatgtgtcctttgtcctcaagaaactcacaggctgttcgtggaggtgatatgcatgcatgagctagcttcagaattattgctaataaggataattatggtggcctgttcattgaatattgcttaatgctcttcaaatgaggcatgcatgtaaaatgtttgggaaacagaagcacaatgcacctgaaagctgatgctcttatccttgcgcctcctttcctgggccttcactgttggtaagagagcaaactgttctggaacgctcctcccagccccaaccctaccccagcccccagtattcccttagagcagagccaggctggaacgagatccagctccacttggccactttgaggccatggcattgaatgaagctaatggtaagactggagggctggtggagaccctgattgcaagaccccctcctgcagcatctggttctgcaggtctggagtgggggctgagaactgacatttctaacaagttctcgggtggtgtcaatgcagccttttagaacctctgagctcgatcaagtcttggacttaaataaacctgggtggcccccaaacgagctctatgactaggcaaggccagtgctgccatcctcgttttacaaatgaggacactgaggctcagagagtcaggagcctccccacagttacacatccagaagcagcctccacctccagagttctggggcagggcctcccgtggctccaccatggagcatggcagggcaggttaaaaggaaagcaaaaccactatgccttgtgggaacagtgtcccccagggctgaaacaataggaaatgagctcgcctcctctccccgcagcctccgggatccacaacatcctgggcctcctgggaaggagagggacttctcaagttgccctgttttctctctccaggttaacatttcttgtggcagccccatccctggggcctcagggtaaatgtgttacggggacagccctaagtgctttttaaatggcactccgggcagaaatgctataacgagatttggctacaatcagattagctgctacagtgcccacacacccccagtaaatatcccggaagacaccggaccacccctggccctgctacaccaagcaagccagacctccccttcctgctgagccaagcctccgtggggcccagggcggggaggaaaggactcctggagaggaggagaggaatgcttgctaaggacccacaggtgttgctcctgtatgagcatagggtgggtagcattattattggtgttcccatgtttccaagggagaactctggagtcggaggagcttagcaacacatgtaaggctgcacaatcagtgatggagctgggattcaaacccagggtgctctggctcaaagtctgtgttgtttctactaaagcccatgcctggactctgggaggcatgcagagggcagaagggacaggaaaggaaggagggcataggaatcacccaccacccacctcctggaagcctctggaaatgagaggctatgagaggggcccagcctcctgaagggatattgggcaacacaccccgtatacaaaaagcaatatgaagaagaaagcagaggcgctgggaggcgcacaggaaacccaacagtaagcccccagcggagcccattgtcctacccctgcccagggcaactccaatgccagcttggccagaattcccctgctccctgtcccacagagggggacaaactctcaggagatcccttgaatggggattctcttgggctgtgttcccccgagacagtgtgaatcaagctcacttccaaacttgcacaggtcagctaatctcttgagactctgttttcccatctgtaagtggcaggggctgtaaaggtgacatatagtgcctggcacaatgcttacacgtggtgggtgctccctggcccatgggtggagaaatcagctgaagcaatgctgctatgcagcagcaggcagcaggcaggcagtgtttccaagaacacgccgaccccatacgcggtagtttctgacttttcctgtctccaaagacttttctctgacttcctcagatgagccctgtattctgaaaaatttggactgccagatgaactacacttattaaataataattaattcattttcccatttattattaatcacagccatatctaagtcgagtcaggtttctgatctgcatgaagtgccacattatttccacagtgcattcatagaatcccagccaaaatcagaaagctgtctccactcatctctttgaaatattgagactgaggccagctccgggccccagcactgtctggcgattttgcctctgttgaagcaggacatttcgaagtgtccaaattagtaaaggaggcattttggtctggcctaagataggaccatatcaaaatggaagaaccaaaaccaaaagccgctcagttggggtttttgtcactgctgtttttgagacagagtcgcgctctgttgcccaggctggggtgcagtggtgccacctcagctcactgcaacttccgcctcccaggttcaagcaattcccctgcctcagcctctcgagtagctgcaattacaggcatgagctaatttttgtatttttagtagagacggggtttcaccatgttggccaggctggtctctaactcctggcctcaagtgatcctcctgccttgacctcccaaagtgctgggattatagatgtgagccaccacacccggccagtcactgttgtttttgaatacttatattttaaccaaataaaggctctaacagatattcctgaccctcacctcctccttggccttggaagagactcaggtcttagatgacctgagtctattggtcacataacttagtaatctaagaagcagacagttaatgatttgatttttagaccacttcaaaatgtccccaagtcagaatatgactgagaagtcagcaacctttctctgaaagactttttctccatagtaattattactatttaataagtgcagttcatctgttgaaaaaaacacaagatgcaccagaggacgtgagaaaaaggtgcttggaaacagaaaggtgggagccgagccctaacgaacccacccatcctggaggcatggctgccaccgaggcctggcactgggacggctccactgacttctctgcccactgctggggaggtgaagggaagggagcgaatgctaccaagccccaacttcatgccaagggggggccaccattgcctggggcctcctccaggatgtacacagttggaaacacccccactcttagctggtaacttatcctgggcccacctcccaccctctacagctttgcccacctccacaaaggaagaggcccagaaagagggagaggaagggggtgcggggcaggcaggagaagacagcaggctggcatgggggcttgggtgcaaccctggaacccccatctcctccacccaccatgtcctgccttccctgccctggacttaccccttcctctgagagctgatgcagtctgtgtgtccaggttcctgggcttcattctccccctgctctgcagatctcagtgacccatagtaagcaccaattaggatgctgtgcctgacaccaagtgtgcaaaggtgatgaagatccagccctgccccagaggccctgctgccagtggtggtggtggtgtgtgcacaggcatctccgtggggtgtagggagaactacagtggaggtttccacaaggcgctgccgcggaggccgggggaaaggcgctgccgcggaggccggggtaaaaggcgctgccgcggaggccgggggaaaggcgctgcactcagctgagcttgtgaatggcttctgccaggagaggggcacctgggttaagttcgaaggccctaagcattgtctacaaaaaagcgggtggccagagcctgcggtgagcacaagaagtcggtactgccgatgagaagtcgggcaaggctggcctcggggagccgaggctggaggcagcagggccaggtcctggggctgcagtgttaccccccaaaaggcctctcgctccccctggtgaaagcatgagggtggaagtgagagaaacggcctggaggtggggagagcagttggaagggagtcactgtcactcaggccatggtcaaaaggactgagccaggacaggggaaagatggcaggggagggtcaggtgcaggggacaggcccagaggtgctcaggaggtgggatcagcgtaagttgaggactgagtgaatgtggggtcgggtgcaacgctgggactacatccacgctctggcatggactgaggaagcgaggacaaaggagcgcagccactctcccacgagcttggctgagaacaggcaaggccagggcagcagcgagaggggccctgatcaggaggcctctgggccgtggtgctgagtaaccatggtgtctagagggtgggtggctggagcggatgggagagtgggaggccactgcagtgccatgagaagaacgtggattatggggtttgtgctggggagggggacagcatcctcgtgttgtcataaaatggagacagatgatggcacagcccagctctgagagggctgttgggggactcagtgagagcccacgggtggcctgccacaggcagaggcgccagcactcagcccagcccgccccctctctctccctgacttctttcctccttcttccctctctccccctccagcctgcctgccttcctacctgtctaggaccagcatccttctcagcccgcagtcctgcccccatctcctccccacccactaccatacacacacagatcgtatataacaccatttgtcaagcatggcccatagctcccgaaggcagtcgtcccacagctcacctgctcttcagacataatggacaagaggccccaggtcccagctggagccaactgaccttgggccacagctgttcctgatggtctctgtcaatgacactcatttcctcacctggggcaccagcgtgtgcagccggacaacgccatcattcaactccacaaatagccatgaagccctactgtgtgcagggcactgagccatggagccccaactgtgtgcaaggcactgagccatagagcccctactatgtgcagggcactgagctatggagcccctactgtgtgcagggcactgagccataaagcccttagtgtgcagggcactgagccatggagccctgctgtgtgcagggcattgagccataaagcccctactgtgtgcagggcactgagccatggagcccctactatgtgcagggcactgagccataaagcccctactgtgtgcagggcactgagccatggagccctgctgtgtgcagggcattgagccataaagccctactttgtgcagggcactgagacatggagcccctactatgtgcagggcactgagtcataaagcccctactgtgtgcagggcactgagccatggagcccctactacgtgcagggcactgagccatggagcccctactacgtgcagggcactgagccatggagcccctactgtgtgcagggcactgagccatggagcccctactgtgtgcagggcactgagccatggagcccctactgtgtgcagggcactgagccatggagccctgctgtgtgcagggcattgagccataaagcccctactgtgtgcagggcactgagccatggagcccctactatgtgcaggacactgagccataaagcccctactgtgtgcagggcactgagccatgaaaccttgctgtgtgcagggcactgagccataccgctccaactgtgtgcagggcactgagccatggagcccctactgtgtgcagggcagtgagccatacagccccaactgtgtgaagggcactgtcccatggagtcctaccacgtgtcaggcactgagccataacactcctactgtgtgccaggcactgagccatggagccctactgtgttccaggcactgactagactggtagaaaggcctgagactctggagcctcacagtctctggaaagaccacaggacagaaaagtttaataacagtccacaatgccagtcaggttctagacaatagtaggagagatatcacaggcatgattaattgccaaagtaattgtatggatagccatcgctataaagggcacagaccagggaatgtcagagatggaggaattaggaaaagatggatgggctgcaggcagaattaagtttgagttcaacctccaccaccgatgctccatgtgacttagaaagttgtcttccctcctctccacaggctccatctgcagagcgaggggctatagagcgaggtcactgaggtccctgcaagctcaggtgtttcaaggcacttagggctacactggccaggaaggtgctaagggagaaacagaccatgaaccttgctcactgatgcaacaggagtggaacctgggccggccccactgagaagcacctgcctccacaattgggcccttcaaccctgactcctatctggataatacaactatatacctgatcagaaatctcccgctgaccaagctccgtccacactcacacgcgtcatgtgtcatcacaataaccctgcagggtgggtaggacagacctcaccatcctgatttcacaaatgaggaaactgagaaacgggagaaaagggccttgcccaggatcccacggggagttaaaggcagagcccagagcaggatgccactctgccgctcctccagagggtgtgccggaaaggaatggggtgcttctgtttttctgagcggcagtccactctctcccgcaagatccccccgtgtgtgtggacactgtggatgtgctacacaccagctgtgctctcatttcaggatccggcaggcagcctctttgatttgctgctaattctttatttaaaaaagattcacaactcaattacatcaggtaacagtttctaatacaaaacacaaacccaataaacatctcttctgaccaggggacatggatttagatgaggaaaaaacaaaaaattacagcatcagctcattgagagcagtatcttgtaatttccagtaaattggaatcactgcaagtcattttccccacttgagtggcaggtatattaatttcttgttgtttctcaaccatcagaaataaattgtttacaagggatgggaagaaagcttcagagagacaggctgaggctattatcatagcatgagtttgtgtaacgtgattcacagggtgcaggggtcttcagaagagctaaggctgccctgtgctttacacagaggtgggccctgggtgaaactgaacagccttgaccccaagcccccttggccatgccctggttcgcccacttggtccccttctgcctcccagaagtcacccccggaaaaggagtggacaggctcacccatgggggcacatgatgacagcagctgccatttgtcactcactggctaccctctgggctctgaagtaggtcccttataagcatcatctcatttaattatcataacagccttccaaggtaggtattattatcccctttttatacatgaggaatctgggctcagagcgggggtaaataatcacccaaggtctcacagctagtgagtaacactggcagggccaggactggggagaggtaagcaaagcaccttgggcagaaaatttaaggaggtgcttcttcttggggtcagtcgagtgcaaggtcctccctgggagggaggcacctcgccgggctcaacctactcctggccctgagtggcagagctgggatctggatccaggtctgtctgcattcaagcccttgcttttctacctgtggcacatcccactcctaaggcaatcagtcctgtagtagcaactagaagcttccagaggagtgaagctctaatggtggaatttcaggcttcaggggactgatgagggagctactccttctaggactcctgcaattatttcaggtaggcagctgcctgctccccctgactttaagccagccccttgtctgggttggaaatgtggggctgaggccaccacccaggaaagtacaacccagccacagaaacctgcttgccaagctctgctgtctactttggaatctagagagctgaccccagccccgggtctcgccttgtgctttgcatgggtttgcagtcttctcaaattcgctttgtatgcccatgagagcaggggttcttgtcttcattttcttcctcagtagtggacgttgaggctctgagaaattgaccatgttgcctcaggtcacacagccagaagaacggggacaagaaccagcagatgacttggagccctgggctttttccatcccaccccaccatcaagaactaggtcaagacatagatggggctggctctcagatgtggttgaggggagcggggtgagaaaaatagcaaagaaggcttaggaagggtaaaaggagtcaggaacaaacaacgtctaaaatataataatttggctaaatttaaacatacgaaagagttcagaatgattcataatgcatggttgatgcaaatgactatgcaaatgatgccaaaaggaatgggcagcatgacgcttacctctcaaccacagcaggagtgggtaggatgaggactttgtcctgggctgaagttttccaagcaaaccacatcttcaggtggagatgacttttttatgcagcctgaccaggactcagaaacctggggcagtgagcaggacagagttggggcccatccacactgctgtccctagactacaggaagccgccacatcgtcccctgcccaggttcactgagctaaataatgctgcttcctcttacctttcaccaataagccttcctttttctcagccttttaattattgttatcaccttgtccatttctcatggatcaggagggagtgtttggctgagagtctgggaattaggaggggcaaatagcttctcagacccctctctttgtgcatcccagcagcacattggggaggaaatgacctctaagaggggatgtgcaagggtttggaccatagccagccactgactggctgtgtggcctcagatgagttacttagtccctctgagcctcagtttcctcatttgtcaaatgagattaataacatttgccgtttatggctattgggtgatgccgtgtgcctgtgagcatgcattgtgcctggcacattggaggatgctggtaatcagcccacagccctctccaaacctacagccctcagcttccccctccatccacctgctgcagccagacatacttgaggctccctgcttcttcacttccgttcacacaagccccaattcccaccacctctttctgcttgtctcagagccctacccatctgcaagctccatgtgaagccaacatcagccttcctcaccccatcaccacaccccacaaccacctgtcgcaatcccccatctccctcctggccctaagcacctgacgacccttattttggccagagatttgcagcttccccggggctttcacccatgagctccttttgttggactatcatgttgtttggaatgaaaatgattcttctcttactaggaaaggggctggggctcagagagggcacaggggcaggaaatggccccacctgatcagggagcccgggagcactccactttgcctcctcaacatagccaccctatggtgagacttctcttttcatcatgaagatcgtctcctcagtttctttgtgagctcttgaagagcctggagctatctcaggttcacaacgccttacaccgctcccaacattcaataaactcccatcaatgcccaggcactcaccagggcaatgggcactagattctccatttgcattccatgaagacctcagttccttgcctgccatgttcgcaaacagcctctgcagaagggccgtgggctctgccttgtgagagctccgggaggcccctcacacacttggaagaagggacatttcctggaactgtagataaaggagctactatgtgcacatgggcaaaactgccttgcatctcttcctggttttttgtaaaagaccttggatctgaatacacatggatgtgaaagtctgccgagtcccataccctggcagctggtccctggggacacatttgttagctggtgcgttagctgtcttcaagacatgccgctcttctgatatggttcagaagagagttcttttctccccatccttgcttgacttcattgcagcaacctaagaggcagcagaaatcatctcccatccccacactctgtttttattttcatcatgatgggttgtttgtttgcacacatatttctccaggaggagttaccagtgagatgggaatagacagtcggctcatatacactgctctcctcagtcattctgtgaggaacctccttgtttccagaccccatggggagactttacaactttgtaccaagtcaattatggctactaccgtcattaataataataataattaactaatactaattgagtgcttattacatgtcagccacaattctaagaccacatgtcttaatttctttaatcctcatagcacatgtaggctaggaggcaagttcacttattatccccatagtatagatgaggaatagggaagttacttgtctaaggtcacatgagtccattgatctgggacaaggagagaaaaccataatgaggaaatcctaggtattcagaaagccatcaccccaatatgccacattcatatagtctcctctctctctctctctctctctctctctctgctgtttccctctctctctcccctccttctctcccttcttccctccctcctccctgcccttttcctctctttctctcttgcaccctttactagtctttcaccttcttagttctgtgactgaggcaactccctgtccctctctaaacttgatcgtcctttcctgaagtgggggagaagaatccctttctgcagggactgatatgggggagaaccctcagaccacgatggcgatgtgcttagcccactggaagctgctgggttggcaggaagggggacagtcttcataccacagcgggagccaacgttctttgtcccattgcagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtgtaagtgcccagagcaggggtttctcgtctgcactctgtcaggccccgggaaggcctcttggaggcaccaacactcaacaccctcctcctggaagttcataccaggagaatgagacagcaaagagtaattaaacagcagctttgcaaactcccagcaccccagtggttcacctcttgcctgtgctagggggaggcaggacctggcagagctggccatcctagcaggaactcagcaccctgccaggtgaatctcctggttgggccaggctccccccctccctcacctgaagcacagcttttgcttgggaaaaggggccaaagcagacagctatgttctagcacccaggacccccagctccttctccagaaacttatttgagaacatccttggcagagagatatgggaagaggggctaccgagaaagcagtttacttccacaaaataaattcagggctcctaagagccaggccctgggctaggagctgaggaagcatgaaaagtaaagttcagtttttcccttctgctccttcggggttaaggtgaaacgacaggagtaagcttagcaagtgcaaccttttgcataaaaaatgtctcaactccaacttttatttagcaactataattgggactttccaacctaatataatatattaagccattaaattacaggctgctataattttcacgggaatttattgagtgctaatgtaattccttcatctaagcagaaagattgcattatcttctgcaagggactttcacttgattggactgtaatcagttatgtcttttcacgggaccgcgtcttttttaaaaattcaattgaaatctagttgttcctcggggttgctgcactttatcatttttattaatcaatctactagctctcaaactttgtggatgcacaggaagttcccaagcaggcaggaggaggcgattctgggccaggaacagagggcagctcactctgctggttgggcaaggcatagcaggggcatgtggggagagtgactggtcttcgctgtggcttcacatctccacctctgaggaggcacttggaaagggggaaaaatggcggttgtcaggcactacctccatctccagttctcactaggcagaaaaaatggtgtctagacacaattctcaagataatgaagtggactctaagaattaaactgcaggggccgggtgcggtggttcatgcctgtaatcccagcaagttggaaggccaaagcgggaggatcacttgaggtcagaagttcgagaccagcctggccaacacagcgaaaccatgtatatactaaaaatacaaaaattagccaggtgcggtggtgcacacctgtagtcccagctactcaggaggctgaggcacgagaatcacttgaacccaggaggcagaggttgcagtgagccaagatcgcaccactgcactccagcctgggcaacagagcaaaactctgtcgcaaaaagattaataaataaaaaataattaaactgccggatgtggcagctttgctggttcaactgcacatctatgggggcagcggggagttgcccttctatgtacccggccacactggagctcctgtgctggaaatgggctccagctgctagaatcctccaccccacccccaaacacagcacatgtgcacatacacagccctccgtctttgcttctccagtgcctcccaaacctcgcctggtggcatgagtctaaatcaggctttctcaacagtggcattattggcattttggagcaggtaattctttgtggctaggggcggggatctgtcctgtgtattacaggatgtttagcagcatccttatcctttactcacttggtgccagtaacagcccccagaaatgacaatcacaaaagcctccagacacttccaaatgtcccctaggaagccaagtctgttctaaatgttaaattccaccattaccatcccctgcaaggcaaatattgtgaagagccagcccacaatccagacagcactcaattcattcaaatttatttaaccaatatttattgagtacctacttaatgccatccctgttacaggaacttgggatatattggtgaacaaaagaaagatctttgctctcaaggaacttacatctgaggagagggagggggaaatatctggggaaacagtgaccccagcaaaggccatgtcccagaggttcatcgatgctcaaggaacactcgggctggaggagagggagccaaaggaagggtaggtaagagataaggcagaggtaatagggctggatcaggccactttaaggcatgttggagccataggagggttttgaggcaaatggtgacataatgtggtatgtgtgttaaaaagctcactctggctgcaatgtgaagaatctaccatagaagaatctatggacacaagggaagggtcaagacaatgaattcaagggctatggcattaatcctggcaagagatgatgatggcttagactaggattgtaacagtggaggggatgaaaagtggttgaattctgggtgtaatttgaaagtcaaatccaaaaggattttctgccagattgaatgagaaattaagagaaagaaaagagtcaaggatgactccaaaaattgtgcctgagccactggaagaagggagctgccatcacctgagttagggaacactgtggaaggagcaaatctgggggcaagatcaggagttcaatatcagacatgctgagttgtagaggcctggtagacagccacaggcagacaggtggacgatgggagacaggccgctagagttcaggagagaggtccaggctggggatataaatattggagaaattagcataaatttgagacaggatgagattgcctaggatgcaatacggatagagaagaatgtgaagaccgagcttaagggaccctcaacatttagaggtcaggaaaagaagaggaaccagcaaagcgggacaaagaagaggaaccagggaggtaggagaggatgcaagaggatggggagtcctggaagtcatgtgaggaaagggcggcagctcctccaaatgctgctactggtccagcaagagccttgaccgctccccacccccacctgatctaaaggagacatcagaagcaggggtgcgggggatgagcatgggtcagaaaagatctttctcttgttcaccaatatatcccaagttcctgtaacagggatggcacaaagtaggtactcaataaatattggttaaagaaattggctctaactacaggaaagcccatcctcaagccccactgctgtctcctccccatcccagcaatctctggatctgttcatgaggggagggcatcacctaggggtggaggtcccactgctgcccgcaagccaagaggggagatggagcagaggccgacggggtggaccttctcagcaccactggttcagactgggcagcccctccatctccagatgaggaggcaagtccagggaggcggggtgcctcaccaagtatagcccagcaaatctccaacagagctgtcaagaacccagactgagcagggtgtgatggctcatgcccgtaatcccagcactttgagaaggctgagtcaggagaatcgcttagttagtgactagcctgggcaacacagcaagaccctgtatctaaaaaaaaaaaaaaatacaaaaattagtcaagcatggtatttcgtacctgtactcccagctactcaggcggctgaggcaagagaactacttaaagccaggagtcagagaccagtctgggcaacatagcaagaccctgtttcttaaaaaaaaaaaaaaaaaaaaaaaaaaaaaaaaagtcgagcctggtagcttgtgcctgtagtcccagctactctggagactaaggcaggatgattacttgagcccaggagttcgtggctacagtgagctatgatcatgccactgcactccagcctgagtgacagagtgagaccctgtctcaaaagaaagaacccagattggaccctgaatcctgtgctctgcccagctgacagctcacatccctcagacccatccccagggccaaccctcagggcacattccctgcaactcacgcctgtgccaggtggcagtgagcagggtctcctcccaggagtctccccccaggccaggacatagctgcacatacatatgggaaatgccagctctctacaatagcaattcagagccttccacccacactagatccactctaagaaatatcaaattatttccatcgttaaatccaaaattccatgaaacaaactgcatctcggctatttatctggaaatttctgtagtactcattgccggcacccctgagcgctttagcgtaagaagtggctcaagaagaatggctgcatccactagctggttacgaagcagcatcgatggaaatgtgatgttttactggctttttttctattaagtgaaagaaaagtcactttcctccaaggtcaggctgatgtttgaagaattcgtctgagctgtggtggccgacaagcaggcgtggctgtttttgaagcaccatcctacttcttcagggattccaggattctgttacagaaatctccagcacaatcctggggactctctaatacctgagccccaaccaggagcatatgtgggcccagaagtgaatctaaattagaacagcagctggctgggcacggtggctcacgcctgtaatcccagcactttgggaggccaaggcaggcggatcacctgaggtcaggcgttcaagaccagcctggccaacatggcaaaacccctcctctactaaaaatacaaaaattagcggggcatggtggtgtgcacctgtagtcccagctgcttgggaggcagaagttgcagtgggccaaggtcgtgccattgcacggagtaagatggcaaaaacaaacagataagaacagcagccatttactcagttcccaccatgtgtgaggcgctccactagatgcctgagggtagtacttgtactacgctcagtaaatgccacaacgacctgtgttgtcttcattcgcagccacactggaagatcagagatcgagggcccctgtcacagtttcccagggtgggtggagaatccagactacctgattgcagggctcactctacaaggcaagcagaggggtgtgccagggattccggagggaaaaaatggaacattagctaggaggaatgagatgtccaaaagggagaactgatcttcccagagaagaactgggaataaaacttgagtctggcctcttgctggtttttttctctcctcctgatgcttcagaactgtgacttctcagaaaacctcgatggctctcagtgagagaacggctctcatagagaatgaagtccactccttgcagtgccttcaaggcctctagccatgatcacactgttccgtttaattctctctacccacctaatttacgctccctccagccccatctcaccacataggacctttcccattctttcttggatctcttcatcccacaggatcgaaacaggtcctggacaatctctctgtcctgatagacttctgggccaaagagacccttgtgcttttcccccacgcaccccactcacccacttccctctgggctcatgccactctctgctcttggaatgacataactttgccccactctctgtgaaaaaaacaaaaacaaacaaaaaaaaactccctatccttcaaggctcaactaaaagccgcctcctacaagcagtcctcacagcaataaaaccttgctctctctctcccagtttctcctagcattttctgtctaagctatccttgtggtccttccctaacactgcccagagtgacagttattggtatatttttctgcctcctcaactcaactgtaagttttttgagagagagtcagatcctgtttttaagcatagaagttctgtctgctgcaaagtggagaactctggtttggccacaaacctaacgtgctttttgtttctacagacaaaccagttaatccagaaagtctgcattggagagaacaatgtgatagaagaagaaatccgtgtgaacagaagcgtgcatgagtgggcaggaggcggaggaggagggggtggagccacctacgtatttaaggtatggtgtgtgctgccagatttccaccaggttcctgtgcatctgcaatgtcagagcctcatgacagccctgggatagaaacacctcagatgctcttatccccgtgtaaagatgagcagggccaggtacagtggctcattcctgtaatcctagtattttgggaggccaaggcaggaggatcacttgaggtcaggaattcacgatcagcttgggcaacataccaaaacgttgtctctaccaaaaaaaatttaaaaattagccagttttggtggcttgcacctgtagtcctagctacttgggaggctgaggcaggaggatcatttgaacccaggagttcaaggctacaatgagctgtcatcacgccattgaacttcagcctgagcaatagagcaagaccctgtctctaaaaccaacaaaagaattaaaaaataaagatgagcagactgagatccagagagatatagagtctgtctgtccaggaaagggtagaactcttctcttactgatacatcagcccaatttcaccatgcacagcctttgccatcctactttcagagagtcccactgtgccctcctggaccagctctctgccctaaggtggactttgctgacatcatcacagccaggccagaaactgaagacagaggccacctgctaggtcctcccacaggactgtgatgctgagggcttaaccttgaatctttgggggtcagagccagagacccctaagaatgagggagagagagcatagagagacctgcttctaatcaccagcatccagacctctgaggccagtctaaggagcttcaggaaaggggctagaggaagtagaggaagcagcctctaagatcaacccccacctcctggtatctatattttgctcttggtatataggtcttgcttctctggttgaaccctgactgatagagaagctggcggagccgatgggctattgtaacaagggttcagagcccgcaaaccacctcagaccactgagaggtcaccaggtcaccccaaaacagcaaaccctcagtcaggttgaatttaccagagcttaggggctccagggggaagcacagctcggtttctcaatgtctgaatgtctcccctggtcagatgaaggatggagtgccggtgcccctgatcattgcagccggaggtggtggcagggcctacggggccaagacagacacgttccacccagagagactggagaataactcctcggttctagggctaaacggcaattccggagccgcaggtaaagcgctgcaagcgtgccctctcccagaacctctcccaggccttcagctgggccccgatgccatcgcatgcctgagggcatcttagtcactggcacctgggatgctaggagctctgaatattggtaccgatatccagggagggagggcaggcagcaccctgggagccctgcaggccatcttgctgacctggagcttggacttgtagaaggtcactgagaaagtgaggcagggagcagccgtcaatcagccagctggccctccctgcaattgttagagcctccccctgagattccttcttcctccaggggcagatgggccccccagttaggatatgagcaggtgaaaaaaatctgggcaatgtcaggcctcctagacccccatggtacagacctccaggccctgggctgccagacccaagcgtatccccgctggaaaatctcttacttgactctccacggctgagctctcctccctcattaatgggagccagaagcacagaaatgtgagacaggcagggaagagagtgtcaattccctgattcctctaaagtcagccacccctaaagacagaaaatgcaattcctttttgtattttcttttccacacaatcagactgtgggaggatcttagaaggcatttaagatttgggattaattaaaacaaatgtgcaaactgtctctcaattgagagacggctagaatagaagagtagaaacagtcatgggtccaccctgaggatctccagtgacgtttgcagcaccgaggcccagcacccgagaaaccctgaagcacctctgcctctgttgcacatgtgctgtcaaaacaacctgcaggtttccaggcagataccattcctgttttacaggagagccaatgggctcaccaaggcatgatgactttttttttctcaacagggccgagctgtttagtgatagagacaatttttgttttttgttttttgtttttgagacggagtctcgctctgtcaccaggctggagtgcagtggcacggtctcggctcatgccacctctgacttgcaggttcaagcgattctcctgcctcagcctcccgagtagctgggattacaggcacacgccaccacgcccagctaatttttgtatttttagtagagacgtggtttctccatgttggtcaggctggtctcaatctcctgacctcaggtgacccacctgcctcggcctcccaaagtgctgggattacaggcgtgagccaccacgcctggccagactcaattcgtatttttaaaacaccgttgttctgattttgatatgggttattttcctttccacacatttgctcgaaggctgcagaacgggtatgggggtcagaaacctcctcagctgggggctgagcaggatgaaagcacagcgcatggtctccgtccatctcgttctgatttatttattacgcgcttactcacagccgtgcacaaacaccagcgccaacttctggcccctaacgcgcctaaggggccttctctctgccacatgacaacagccttgacaggcccacaccctcccctgagagcagaagggaggacagcgaaacaaacccaagctcaacacccacccctggaggtttcatggctaacaaagtccccccagcttgcctgatggcctcgcctcagctctgcttgtccccattctagattcaagcttgttcctgacctcagcttcattttcaaaacctggcttcctctttctagcaagacagtcatcccacctacaggtccctctgggtcccaaagaatctgggccacaagtgcttccagaaaccctgccaggccggttcacccgtagggttccggcagacacacacactgctgtttctgccttccaccatcaatttccaggtccccagcatgcatcatctgctgcagcagaaagggttttagggtttttagaatacctccaccctttcctatccatcagttctgcgttcgtgggattcaaccaaccacagatcaaaaatactcaaaaaaaaaaaaaaagatgattgtgtctttactgaacatgtacagacttattccctaaataatacaataactattacataggatttaccctgtattgggtattatatgtaatctagagatgatttttttataggagaatgtgcaaatactatgccactttatataaagggacatttattttggtgtgatggagggatcctggaacctccacagatactgagggacaactgtagatgtctattcaaatgtcctatggaacagtaggcataggggatatcctggaatctcaaaggttagcagaagagatttcttgtggtcaacctgtggctacattcaacctcggctctgtagatagcttcctttgtaagagcccaaagcagccccaggcattgggaagcacagccctgaggctgcctttgttgccagggtatcgtccacccaccagggcttctgctcctgaccttggagcagttcctgagcgcctggccctggagaacctctaagcaggctgagcccaggtgtgaggctgtctgcacgcgtgtgttctgcctctcgagcccctgacgctccccacccctggcagtttgtggagcatttcgtacactcactgtctcctttgagcggaacatcaaccccatcaggtgggtcttattatccccaagccacaggtgaggaaacacaggctcagaatggggcgttcttccccagggtttcacagacagcaacgggctctctggtcagcctagtccaggattcctgcaaggaactttagtgcaaggttttgacatgtggctgctcaaagactggtgagtcccttttctcgttaggacgggaggcagttaatgaaacgaaggtccagtgctacggggcttggctgacatgaagagaagatagaggaacgagtttagtcgccatgctgcctgtctgcccacgtccccccatccttaaccaagcacagcccctgcttttgagccagagagtactggcaggaagcaggggtacaaggcacgctctcatctgggtgtactcagctgtggccaaacaggtctcctagggcaagcagcctcctggttttcctagtgtggatctgaagcccccaggccccactgaagatgggccccgggagctggagctggtgcgggcgccctccaaggcgtcctgcatcctgcttctctggccagcatggctaattgaaccttgccagcatcctcacgcaggttccctatctcttcccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggtaaagatgattcgtgttcaaggtgtcactccctccctgcttagtcctaggctcctcacctccctgccctgccctcccctgccctcccctggcctgcccaagtgtggactgtgatgtgactgcacgcctccctctcgacctgcctggaccagccagaggcagggtgctggctttcgagccagcaccctgcctccaggcttcctcagcgacagcatcaagatcccatgtgattcttgatgtcccccaaagtcgatgataaagaggctttggcttgccagactagtctctgagtcacccataaggactcccccagcctcccttggatggcctggccaagccagctcctgaaggggctggtttgtggtttcatggactccttactcctgctccctacctcagcccaccagcttcctgaaaggcgccgctgtgcctgctgatgggagctattcccgagggcaactgcaggcaggcttagcccagcccttcagcaagcagctgcccattgaccccagctgcctcgtctgggcttcagagcacagtcagcagagccttctgaagctgagaggctgggagacgatggctccccgctccccacagattaggacgaatgcatgcatgctctgtggtgttcgtgtctgtgttttgcattgacgctgtgtgtaagatgcttgtgttaaccacatgctcttcttttccaagctgggtgggtgggaggagcccgaggggggagcccaaagatagcccagccccagatgaaaggagggacgggagcctcagggcacaggggctcatttcccgcaatccgcacagcccgccacaccccaaccctgacccaatggggctgaagagcaactcttcagtgctaccatcctgaccagtcctgggagaggcaccatgggcatatcccagcctggaaagactagaactttttggactcttgctcacattaaccacttcttagtgggccaccggcagagtgggagctggcctggacctgaggggaaattagccacacacccagcatctactgagccaaatcccacatgcagcctctgtgccctgagcctcccttccctccccgcatccctgcccctgaggtccccagtgaccccctaactttggccagagctgcatgccccactgacgtgtgtgtgtgttaagattttggcacccaccccccatgttaaactctgctctggtttgctactcaggcggcaatgcagcctcaaacaatgaccccgaaatggatggggaagatggggtttccttcatcagtccactgggcatcctgtacaccccagctttaaaaggtagcttctctgccaggcagcagaacaaacttgcttaggtcagtcctcccaccaagctaaaacctcagagtctctgacctgtatccaggatacagaggcacaattatgggtccctggcaggcaagcttcctatggcgcaggtcaccacattttccagaagtcaggatgtgtgctttaatatgaatgcagaggcagaatcctaggaaatgtaacagtaatagcccaatacctgcaccagccaacctaaagatcatgtgcgtgggcttctctccaccactgactcaaaagcaaacatccatagacacccatgcccgctgcctccgctgcactctctatatgcacaggaagactcttctacacagttgtgcttccagtggctatgggacctaggaacagggaccaccagagcacccacagtgaccacctggagacatagtactgaggctgggagtggggaggcaggctcggcccaagactgaccctccctccttgtcactagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattggtaagggggcagggccaggggaggcagaggggcccatagcctgagatttggcccatgaccacaaatggtttctgggttccagaacaccctggattcggttttgtaaactttctgtccctcccctacctgccacagctcgagtgctctgaccactgtgtgaaaggtgggtcatggctcctgaaggagtcttaaaaatcctctactatagaataagccctctaccacccccaccaaggggccatcctgcctccacttaaacatgcccagtgacagggatcttactgctcctaaggttctctgttcccttgggcagtttcagagctggggacctgttgccttaaccttcctctcctaggtttccttacagcagcagctgtgcatgtgcagtgtttgaagacagtgctcccattctcctcctcttttttttttttttttttttttttgaggcggagtttcactgttgttgcccaggctggaatgcaatggtgtggtctcggctcactgcaacctccgcttcccaggttcaaacaattcttctgcctcagcctcctgagtagctgggactacaggcgcccaccaccatgccaggctaattttcatattttcagtagagacagggtttcaccttttggccaggctggtctcaaactcctgacctcaggtgattcacccgcctcggcctcccaaagtgctgggattacaggtgtgagccaccgcacctggccccatcctcctcctttaactcttcttcagactaaataacccatttgtttgcagcagttcatacaagatgcagttttgtgtctcttcccccgccccaccagtgtccctcttctgcatgtgttccactatcgatgtcccttttgaaatgtagtgtccagtaccaagcacgatacctccgtgtggtctggccagcagagggcacaggacccctccccactgtgagcccagtgcctcagggccacaaggaagtaacttagcctcagagggtgttacttacagcgcaccctgttgtttggtcacctgcggcccccacatctcttccagatccactttcgtttcaccttccatcctcaccccatagttgtgcagctcatgtttcaaaccaacatcccgccactgatattcatccctgttaaatttcccttcacccaaaagctactgctaaaagcctgtcaaatcgggatgagtctggtcctgctcatggtcccctgaaaagaaaagtgtgacaaggtctccagcgatgggaaggagcaagtagtttttgtctcagtgggggaggttatttctgacttgggaccaactcaaaggagacctggtgtggttgtcaataccccagtgggacctgtcttccagtgtcacccaccccggagccacacctgccactctcgctgatcctctctgtggtgacctctgccctcgtggccgccctggtcctggctttctccggcatcatgattggtgagtgcacagagccccagggactcccaagggggcaggaaggcaggactgaatagtgtctcaggctgtgccacaggtgccaaggtgtcacttcgttatgctagtccctggaattgggtggggtggtgattagggcagcccaggccaagccaaaacggaagctcccaaccttccccccaccagagcagctgcagttccctgaggagcccctgattctgcacctcagccccgtgtgtatcctcctggctgatcagggggtggggagctccttcagtgtccatcacgatggtgaaagctcgcccccacccctagacgtcacttctagctcccacatgcttccaccggcgcagctcctgtttggctcccaccctatgtaatgcactagcccactcttccccaaaccagccctccaccaccctccaggcagagagataggaaaatcggtttctgagtatatttctgttcagcctgtgagccaaggtgagctgacctgcaggtcacagagaactcagtgtggtcccaaccagctcttactgctggcagagacatgcccaggacagatgggcagaggcttgaaaagggcagagggaaaggctcttgagagccctcgcaggccaggcccctgcaggcaaagggatctgccggtagaagggagatggcagcacacactgtgtccccatatggtgccatccctcaaagggacaggataataggagctaacacttgttgcatggttactacgtgctcggcaatttacacatttcaattcattcgatcctcaggtaaccctaatctgatcacggtcggtccattgcatagaggagggaactgagcacatagcgggtgactcatttgccctggcccatgtgttggggggctgggctttacacacagaatctacccactgaatcacaattttgttctggcttccatggagtttgccttccagaacatcctcacatgtaggagtgataatggtcactcacattggtagagctctttaggatttttcaaaaccattttatgttggtgaattcatttcattgacaaccctagagggtggggagtggcagtggttagggaaacagggcaggagttaccatccctgcctacagagagggaaactgcagtccaaagaggtcctgtgacctggtcctcatggctcagcttgtaagtaacaagaggcggaattagagcacagatccccagacaccaattcagagatcttttcatgatgtggctcttctccaactctgtggcttggcagttctccaactataggaaacacaactgaccaagatcccagctgcaccctcaaatccactgctgtgattgcactgaagctgccctacccaatggctgagcacagcagaaatactaaggcaggccaattcctgggagtcatgggactcctctgatgactgactttggctccagaaccccttagggccttgctgaaacttccttaggctccatggcacccagggtgcttccacccaaccttccctccctccctcgttcacgtggggttatacttgcaacacagtctgctggttcacccagccttccctggctccctccccatttcctctcatgggcatttcttctaataaaatctgcagaccatattgggtctaatcccatctccagtctgcttcttggaggaaccagactaacatgactctgccctatataatacaaataattattttccatatatctgatttttagctttgcatttactttaaatcatgcttcaattaaagacacaccttctttaatcattttattagtatttctaagtatgatggaaaggttcagagctcaggggaggatatggagatccagggaggcttcctgtaggaagtggcctgtgtagtgcttcaagggccaggctgccaggccatgttgcagctgaccacccacctgcagtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggtgagcgccctgctgccgtcctgggaggagaggggtgcagtgtaggggctgaatgttatcacagcaccgcagactcctctagccacaaaaggccggcagagccctccctatgggcacccctagccctcctaggaggacaagccttgacattcagggccatgtatgttggcttacattaactcccatagtttatggagtttatacaatgagaggagaaccagggctctcctcaaaattcattcagatgtgctctctccaagtctacctggctccccttccctccaggggagcaggggagcaaagggcccctcctctgagcatctagagcaactgcgccttcctctgtcactcactggaaatactccccagccagtacccacagtgatctgtctctccccaaggagcatgaacctcccccggggaaaagccatggcttatgcacccctgtgtccctggcaaatatcagagactcaataactactgattgaatgaataaacatttgaccattgtcatgagtccctggttggaatccttcttaccagttttcaggtgaagaactggaagcccgagattgcatagcaaagccatgttgagggtattactcctgagtgtgtatgttacccccgcctctcgtgtttgtccactaaatgtgacgcccaggctcaggacccccagctgcctcattattgtggcctgtttgactctgtctcctcttgtcttctcctttgcacaggggtctgggccatggcgcctttggggaggtgtatgaaggccaggtgtccggaatgcccaacgacccaagccccctgcaagtggctgtgaaggtaagaagtggctcactcttgagcctgcccttggcttgcggactctgtaggctgcagttctcagctcacagcctcctcctcctccccaccctccccttctctgcccagacgctgcctgaagtgtgctctgaacaggacgaactggatttcctcatggaagccctgatcatcaggtaaagccacagagagacaccctcaccccaactcccctctgcccccaaagaacctggagaggtttctaacagatcgatatctccaagggaaatcgtgttgtccctagcatgtccccttttctccagtaggagactcccaaacattctagacacttcttaccagaatggaacaacccttgatggttgtttcagaaacaaagtctgtgtggcctaataatcccaccgatgtcactgtctgcaaccagtatccctgctgttatccactggttcttcttccctcactttttcttaagaaatggagcatgctagactttgacagtacaagatataatctccctccaagacccttcaccaatcccagtaattgtgcttctaatatgatgggaggccaccccatcctaggctcccatcagcagggctgagtctcagctggctgcaccttttgacttgaggctccaagatctggatttaagctgagagtctcagtgcctatggctcctgagggcgtccgctgtgacagcagatcccctcaaggagggggcagatatttgacctcaagatcaggtgggggctcatggccccctgtcacactgggaagactctgaacgtcctgacaggtgggggcagactgggatgtccccttggtggaagtggcaggggtaacaaggccaggcagtgtgagtgatatggctgtgaggtctggaaccacaggaggacacacaaaataacatttattttctgatgatacatataattcctgattatgaataaaacttggcaagtatgagattatattgaagaagacccatatcactcaaatctcactacttggtggtaactaaccattattatgttggtgtctaatcacccagtctttcaacacttggggggctgtgtgtacatgtgtgtatgcacacacatgcatgttggcccatgtggaattcctaggccctactgccctgtgtgtcctaaagggatcatgttaacaagaaaacccaagtcttggtccctcccatgaggaatccacgggaaactgatagactcgtgaggccatccccttttgctggctctgtttcacacgctgtcacttggcaagtctcacccagtctctcttggaagcagttgttttgcttcaccttctgcctgaggccttcctgggagaaatcgaccatgaattctagcacccagtccacgcaccagtatctgagaaagacactctcctgccccctgagacacttcctcacccaagtgcctgagcaacatcctcacagctccagccactctcctgcaaatggaactcctgtggagcctgctgtggttcttcccacctgctcaccagcaagattctgggtttaggctcagcccgggacccctgctgcccatgtttacagaatgcctttatacattgtagctgctgaaaatgtaactttgtatcctgttcctcccagtttaagatttgcccagactcagctcagttaattttggttacatccctctctgctctgcagcaaattcaaccaccagaacattgttcgctgcattggggtgagcctgcaatccctgccccggttcatcctgctggagctcatggcggggggagacctcaagtccttcctccgagagacccgccctcgcccggtgagtgagaaccagtctttgctgcagttgttgtgccaaggacaggagcaaggatggaaggagcaagagtgggcagcctgggtagcaagttcctcgatggaacccagggtgtcaactttaggcttggacaggggggtgactgactggctggaagagaatggacagaagatagaggtagatgatggctgagccccagccccaaggagcttgtgcaaggctcctgcaatgcatttgtattagtccattcttgcatttatataagaactacctgactctgagtaatttacaaagaaaagagatttaagtggctcatagttctgcaggctgtacaggaagcatggttggggaggcctcaggaaacttacaatcattgcagaaggtgaaggggaaggaggcacgtcttacatggcaggagcagaatgaagggggaagcgctgtacacttttaaacaaccaggtctcatgagaactcactcactatcatgagaatagcaagggggaaatccacccatggtccaatcacctcccaccaggcccctcctccaacactagggattacaattcaacgtaagatttgggcagggacacaaatccaaaccatatccacattctatagcctggatccattctcatggcctgctgactctggaaaaccaaactagagacaaacacagaggagaactttcatgacagccatgtaactactcaagcaactgacctgggcaggtcactctgcagctactcattcagagcccacagtcctcacgtctcaagtagggataataatacctggacattccaaccgtatatttaggaaggtgctacacacatcttatggttaacagagcttgggaagtgaagatacccagggtggacccaggaatcccaagctccagctccaacttggccattagacacccgtgtagtttagggcagtcttaaacctttaacctgggtatcctcacaggtgagatctgaggattggactagaacatctcaaaggtggttctaaattattaaacatagcaccctgggcagacccagagcccagctgcccatgcttgggtctgcaggtcttcagcaggccccggataccaggaactggagctgagcaggccccaaggttaggatccaggcttcctcaacgaaccactgtactatggggatcacaaggaagacttgcacagtaaaagcagcggccaccctcccgctcccaggaaaggagggaagactgacagccagtggttccagaaagcccaacctgaccacactgctcaaagggactcaaagtggtgatggaagccctgcaaggtcatagctattctgatctccaccttcagtcaggatccatgtaaaataccttcaccttagccactgggtgacgcatctcagtatctaagaagaatactgtcttaccccttgagaagaggaatttgtgtgcacctgagcatacctggcaggaggactgggcagggagcagggagataaagactacacctgtctgtctcataagagccctcatcagctggcatcctcctcagacctttcacatttctcaacaccaccctatgaacagacaatgcaggtctctccccaattctatggatgagaaaacggtggcccagagagattacgggacttgccatggccacacaggaagtggaagagctgggactagaactcaggccttgtgactcttgattcagtgccctctccaacttactgcttatccagtggtcccctctgggaagctgtaaactatcaagatgaggttgtgtccttagagccaacactgccaggcatccaggcatctctgccatggtacaggcatcagattcactggctttcccaccaccacctaggaaggcagagcctttggccctcatgccctgagattctcagcagcactgctgtcagtgggggacacgtggcatcacactttgggaagaggcacagccctggttctcccactggaccttcctgaggcttaaggagagaaagttgtatgcatgcaaaggagagggactttgcaaagggagtctgggagcccagcacttggcaagttcaaggacttcgggggcaggagatggcaggagtgaggagtggtgtgtctctatctctccctctctcccctccccctttctctctccctctctcaaagacaaaggcatctctctcctttgatgatgaaagatgattccaatattattacaaagaacatagtccagcaaggaaaggcagatcattctctctctctcactacccccaccccagagtgccaccctcggagagtcagaacaggagcctgtccccaagttctaccctctaacagcaggcactacctgagggacccccagaacggggagggggcctgtccttggaagagccacttctcagggccagagtcccaccctcacccaatctgctctttcaacccttggccccgcttttcctctgtgtggctctcgttgccaaccaggcacacccaggcagcaccccagtcatggtcctccccgcctcccatacacccaccaggcccaggtgagctgtccttcctgggatccttggccgatttcaaatgtccaattgtggccctctagagccaccaatgcagatgtgtttgtggcagcagcttccctggggcttagctgggcttcctgcatggattctcggggccacaaaatccaactttgtaagatgaggattcagtggactgtgagaaaggaatgtgatttccagcagacagacaggactaatatcagtaaatcctacacaggataaaggagggtgaatcggccaagggacatgagggatggagaaacatgtgccatgaagagaaagtaggcggaggtgtgcctccagattctgaaacttggacttcagaggcctgaattccacctgattcgcttgttggaatcaccctgatactcctgatactcccaggggttccctgatgacctactgtgtgcaggaaccaggcttgaggtgcagaatcagaggtctctgtcctcacttcctgccagctctgtagctcagtggctccacagaccttagatcaggatcaaagaccctttgagatgggataaaaggctctggcctcagacaacatctgtgcaaacatgaaatgacagaacggatgtgcagacgcggtagacagagtggatgcccaggtcagccgtgcctgttgtggaaacgaaatgcatgggtacagatgaaaaaatcacttggtcccagggtgcactggctggcaatgctctgcgagtctagattcagcatcgggtttgccaatgtccacagctcctcccaccccaccccacccatgcacacagcccctcccagacacacaccacacacgcacaacacatgctacacacaaaaaacacacaccacatgcatatatacacacatcacacacaccacagacatgcaccacacaaaaaacacaccacacacgtacatcacacactacagacataaaacacatctatgcaacatgcaacacacacaaaacaccacacatgtacacaacacacagacatatacacaacacatacactacacacacacacacacacaccacacacgccccccccccacagacacaccacatagacatataccacttacatacactacacatacacatacaacacacaccacacacatgcccccagacacataccacatacactcacgcacacaccacacacacctcacatgccacacacacaccacgcacacaccacacacacatcacatgccacacacacaccccccacacaccataaagacatataccacatatactcacaaccaatcacacatgccacgcacacaccacacacatacaacacacaccatatatactgcacatatacacaccacacacatatatgccacatacacccccacacatacacaccacacacacctcacacatcctacacaaaccacacacgtacacaaaacacaaacacatatacacaccacagacatccaccacacacaccatacaccccacatatacacaacacatacacaaaacacacacaccatacgcacatatacacaatacacacgcacaccacagacacgtacacaccagacaccccccataacccacgcttgctgactgtctgccctgtgcacactgattagtggagcagttaatctgctctgagcagccaaggacagggggccataacagcctagcccgtgagttaatgcccagagagatttagtccccacagcgctccaggctcctggggcttccgagacatctatggccctcgcatcctgagtgatggatgctaagacacaaagagactggtaggaagaaaatcttcctcaaggccctagcacagctagggccagggcctcctctggtagggacagagagcatgctcctgaagagcaaaaagatatttcgctcttccatcctgcaaacccaccatggggagcacctgcagcaaggcccacgaccatggccatgagaagaacagctgggtccgaggaagtgctgcactccagcggcagatggggataaaatcctgattccaactctttgccgcaggagggatgatgcaggcatgagtgctgcttgatgggaatgatcagagtctctgctgcccgcctgtgcagaggtaccccctctgcccctaacgaggcctctggataagccaaacacaaggagccattttctgagtccccctggtctcccatgtggaaacccctcaatacctcgggtcccctgatgaggcactgcccgaggctgctggcgtgggtgctcctgacaacccagggagaccgacagtcccacgccactgtcacagatgaaactggctctgagaggctgagcagccagccccagactacatggcctggaagaggccagcagggtggagcccgggtcagctcgatgggccactgaagtgtggtgtttgccgtttgtgggtgctgtattctgcatttggtgtgcattgggcactgtagtcacatacatacgctccaacccccttcaggcactctctcttccattttaactccttggatcccagggaagagggaggatgcctctcccaacccagatccttaaagcccatctccgggcagctttggctccacgcttattagctgtgtgacctggggtgagtcaggtagcctctctgagtcctcagccttctcatcgttaatatggagatcaccttctcttccctacctaccacacagcagatcatgtatgtgctctggggcatgtaaggcaccggtaggggaactatccactctcagttgtctccccaagaactgaagcacggcctagagaagcaagactctgtctacctcctccagacccaggccattgctccagggagtcctggggaggccctgatctatggcagagaaaaacctccagcaggctaagcctgcacccagaccccacctggttccaccgctgccgcctggctgggtgacttccctgtgggcacctcaggactaaagagcccagtcctcagcccacccttcaaaagaagagcaaaataggagagctacaagcatgaatttcctgcagggagtttgcccaggtgctcaagagtcaccagcttaaacaaacacctttcttggggcggccctaaaggggattgatttgaccccctacctgcgtgtgctttcttggggaggtatgtgaatcatactcctccaggtaaatcctggcctgcagctataatcaaccaatcagccacgcaacactcactgaacccccagtgtgtgtccagcattgtgctgggtgctgtgggagggtgagatccctgtctctggaacttcatcaccgtgacttggggaaatggtgaaatcaacatggaacaacacagtgactcggacactgcatgaagctgagctgccgcacacgtcagggatttaggaattaaaagagaggccaagatgggatgtcgccttctggaaaggcttcattgtgctcagcaaggctgtccaggaagccaagatgagatgtccccagaggggtagggaggtgacatctccttttgaatgaaagagacctcatgcggaaaagcttgagatagctcataattgcccagcatttcccaaaagcttttctttttcaatcaattttagcgctggatctgcttgaagaaaattagttttaagaaatattttaagacatttaaatcgaggatttttaaaactcccctattcccctgtggtttcctcacaaacttgtttataaattgggggtattcaaatgcttatgaagattggggtgagagaatgtgcacaataaattaaaagggaaagaacacctgctccaacctagcttcccggagtctgggtgttccgagccttcgctgcacgctggcatcatattacctgggaagacttcaaatgtacaaatactatgcccacccagagaggtctgggttggggcccaggcatccaaattctttcaaatgcctccaggtgatttctaatgtgcagccagggccgaggcccctggtgtagctgcatgttcacggtctgcctccttgtgagcactggaagccagcatttcagatttccctcctctcactgacaagctcctcgtcagtggcccgcttctgtctccccacagagccagccctcctccctggccatgctggaccttctgcacgtggctcgggacattgcctgtggctgtcagtatttggaggaaaaccacttcatccaccggtgagtcaaagtgactgtgctcttcctgtcatcctgtcgctgatctgtgtgcttccccgcagatctcaagggctcacatttcccccttcagagcagaatactaggtctccctccagagccatttggatgtaggatgattcagctttgttttattgtttttttgtgagagacagggtctcactttgttgcccaggctggtctcgaatttctgggctccagtaatcctcccaccttggcctcctgaaatgctaggatttcaggcatgagcgatggctcctggccccttcagctttgtctttgagatggtaacttattctatcagggattcacttgccccttacataaaacaagtgtcataaaatatcctcgccagggctggagacctataagttattcttaacctcctgtgaggacccctgcctgtatcttgaatgttcaagtcctatatcactttaaggcttccccctgccatagaaaactgggctccttatggggaagttaaggaattgcatttttgacaatgggtggcttataggcaaggatgctgttttagtcatctttgtatacttggcatagacacaatgtttgttggatacattaattttttctaaaatactctgaaatgaagcataaagatgattttcattgcttctatacttagtttcttctattacaatcattcttgtgtttaaaagctgtatagactgggacatcatgctgtgaacatcatatatcatgtatgtctttccttgtgaaagctgatgactttctcagctgacagcttgaaatcagaaaagtaaaacagatcatcaggctctttgcaaagctcttccttaatgatttgcctctaatgtagtaaataataacctggtgaactcacaataatttattaacacatgtcttctaagagtttaaggcatgttcataataattaaaatatgtaagtacaaaagagaaaatgagagatgttgtaagagcttagaaatagaaaagtatcatgcctgtaatcccagcactttgggaggctgaggcgggagaatcacatgaggttgggagttcgagaccagcctgaccaacatggagcaaccccatgtctactaaaaatacaaaattagccaggcatggtgggggacgcctataatcccagctactcgggaggtgaggcaggagaatcacttgaacccaggaggtggaggttgcagtgagctgagatcgtgccattgcactccagcctgggcaacaagagcaaaactgcatctcaaagaaaaaaaaagaaaaaacaaagaaatagaaaatcatgcaaatatataacaagttatgctttctccctaataaaaatggggaaatgagaggtcaggaagtacacttgcctaagttccaaagtcactcctaacatgaggcagtcaactctcagaagagcttatcctcttcctgtcacttcatccttttagccttcagttctccctccagcttctaaccctttccaacttgcaggtcatactgcttcatagaaataatggaagccaaaaaggagctgggcctagctttaccatctgctccttctaagagtctatcagttctgttcttttttttaaggtagtttttcagccctttccccgctccccagtcctgttcttgtcctttgcattgtacccagaactttccataaatctcagctctgggctttgccattccattgctcagtcaagaccaagctgtgctccttttgaagtcgtccttggttagagtcatctttccatctttgtccatgtgctttaagtctagactcctatgagagcaacccgcgtcacctggtggccagatgtcttccttcacttagcactgggatcttttctacttgtcttttgttttttatctctgcccacgttggtcaccatagcatacagattctctggctgagggatcatttccatttgtcctctgaccttttgacatctcctttcctacagccacaagacattttgatgatacccaatgctctgttgctatgatgttaacaggattacattccctcaagactcctgtcacttccatatctggaaatagttactgaaggttagaattagatcccagagtaatcatttattgctcttttctcctttttaagaaattaaattgtcaaacaccaaatcaagaaggtatcagatgatctgttttaagcaaaagaaaacttctggcagaaactgtccttctggggcaatttggtcatctgtatggaaaaaacgtcttttacatgttctaactagctaagaggtctgtggtacatacccacaacagagttgcctcgaattctctctctccctccaccctttatctgctcttaagattcatggacttccacacatgtatacttttacgcttttggaattcagagtggaacttcctcaccagatccacatgcttccatttttttaaaaaaattggatctttttcctttggacatggtttattgccatttcataaatgacgtgtcactctcccaactcttgatgtattctatgtactgcatttaccttcttgccattaaattcacgatcactttttaaaacaaccattccatacacatcagtgtaaagacttttctggagccataaatattgttcctggtctactttgctatatttctcttgagaattaacggctatacagccaactatttttctttctttttgatgtcatatgtgttatgcttttatggttttatgggggcattttatacaccacctcaaaattcaacttaaaccttctggatcaggtcagcagcattaacaacatgaatctcctacctgaacccgttattcttgtaccctcagtcatgatccccaatcaagatccttttttttaaatagtatcctagtagccagttgattctctaagtcctttctcaacctaggatcagaaccatcatgaaaccagttgaacatgaaaacagcagctgtgctccctaagtacatcttgttttttcctgcacaggaccttaatattattagagacccatcccagacttcttctggctgtatccttcattcctacatgcatgaccagaatggtaagcagagagtagaagctgatgagtcttggacagcggttgaccatgcctcagaggcaggctacaggaaagcaggtcatctatagtcaacagcagagatgacaactttatcacctggaagaagcgattcttcagccatgtagcttagcaagggctttagataaaatcatggacaaaagaaccataatggcttattttaaaaattaataataataactttgggaggccgaggcaggtggatcacctgaggtcaggagttcaagaccagcctggccaacttggtgaaaccctgtctctactaaaaatacaaaaaattagccaggtgtggtgctgcatgcctgtaaccccagctacttgggaggctgaaataggagaattgcttgaacccgggaggcagaggttgcagtgagccaagatcgcaccactgcactccagcctgggtaacagagcaagactctgtctcaaaacaaaacaaaaaactagaaatatttgtgaatatcttaatctacttgaatttgatttcagggaagtcatgctgttctaaaacactttttcaaacaactggcagaaaccagcccgtggtttgtaccaaatctgcctaaggccagatagcattccttatggccctatgttatctacttttagcttactttttaaaaaataaaatgaggacagtaatagcaccttgtgtcttataaggttgttgtgagagttagatatgaagcacttacaacaacacttagcacctagtaaaaggctaataaatcctagttcctagtatgatgcatttcattatggttgccccattaaacatttttaatcatttcccctaatccttttccatttctctcttagttgtgaggcctagaattgttaaggctgtttctctcacactgaagtatactatactaaaggaaatatagggaagggaaggaactatttaaacttcagcttggagataaaatcctagtgatggccgttgtacactcatcttcctagggataaaattaggaaatgcatttcctttcttcccagagacattgctgccagaaactgcctcttgacctgtccaggccctggaagagtggccaagattggagacttcgggatggcccgagacatctacaggtgagtaaagactgcctcacccctccgggcctgtctcttccacctcagcccctcaagaatggggtgtggctgcttgtcccttacatcatctcctggtaccctgtcaactttctacctaaaatttcactaagttccttttcaggctatgggaaaccttaattagtgaccatgcccgaaggcctaaatctgggatcacacttcctgcagtaattgacaccaagctttttttttttttttttttttgagacggagtttcgctcttgttgcccaggctggagtgccatggcacgaactcggctcaccacaacctctgcctcccgggttcaagcgattttcctgcctcagcttctcgagtagctgggattacaggcatgcaccaccatgcctggctaattttttgtatttttagtagagacgaggtttctccatgttggtcaggctggcctcaaactcccaacctcaggtgatctgcccgcctcagcttcccaaagtgctgggattacaggtgtgagcctccatgcccagccaacaccaagttcttaattaggttgtccatcggttccaactgtaatctggccatgctctgagacatgggataacttggatacttgatgtggaaagaccttcaaagtgagctttattgaacttcctcaactcctcagtactcaggaattctaagtggctatggcttctaacaccgcaggcatctgcatcccaggtcgggcaggatgcagggcctggctcattgctcagctttagccaccccaggagatgtggagtatagcgcagaacccatcagtacttagcgcagccttattttttttttccctgtcacattttcaagactacattttaaaaattattttttttttcagttttaaaagctaatactactttaattgtactttttctcactcttctcttcctagcctctagttcctttttttccctgattatttacaacactgacttgctatgtgagctcagcaagtccctccttgcacaggatgaccccttccctaactcacaggggtagagagaggagcaatcgttatatggagctttaactctttggggaataagtgagactgatccagacaccacccctgaaggcctccatcaaacatggtaacagtccccacaggggtgagcatgctgaggccatcatgttaccacggggcagcagcatgtggaagatgtagtaaagacgtctctggagtgtctaccactgctatccgtcgcactcctctcctctgctccacttcgccttctaacactacccacaagctcagcgttccttcctctccctcctcagaataccctgggactgcctctcatttcaaatacaaatgctgcagcatgactcctcgagccctctgttatctgacttttccttcccaggctcagctctgacagctcccagctccaggcttcaaccaccctaagttacctacagtccttcattccccacctactctgcactttgtacaatggcacgggtcaggaatggtcttctgggagagcgtcttttctcctcagctccatcagtgcccttctgtgaagctttccctacccctgcctcaagtagaatgaatcaattcttcatttgtgtcactgagccttgcacatacctgcattactgtgttttctatattgcaatgcatatatatccatttcttccactaaacaatatccttgggagagagagactgacctatttatgtcctcagcacatggcagagtacctgatacatactaaatattcagtacttatttattgaggtaattaattaatgtcgacagctggcaggaagctgcttcctgtaacacactcacacaggagaacaccaggctagacatgcaattggcctaacaggcagatgagttaatttattggtttttagcagtgagttgcattaatgacattactgatgaaaactaataaattaactcatctaccttgtaagccaactccacacctagccctgtgttcttttgtctgggtgtgtcatgggaggcagcatccacacagctgtctagattactggttgattgcctatactgaactaaatgctgtgtgagtgtcagaggatccaaaatgattaagacacaagccctgctctcagttctcccattttggatcttgcattactgcagatcatcagaaacacactatacttataaggttggagtaatgttattcattgtgagctataataaacaaaacccaacagagaaagctaaacatctgctagcaggtatcttagtcattgcatagatcattcctctcatgcctctcgtggtttgttttgtcttctattaaatgacaccaaagttcttaactaaatgatctgtgtgcccctgctctcctcctgaaccgccaaggactcatggttaatttcagacctttaatgggtagactatattgttgccactttctcaactttcccagcagggcagatgcttaatgccatctccagatcctagtttggttttcctctccttccccacagggcgagctactatagaaagggaggctgtgccatgctgccagttaagtggatgcccccagaggccttcatggaaggaatattcacttctaaaacagacacatggtaagtcagccatcatcctccaggtatccctgcagccataaggtggtgctcctgggccaaaggactctatactctaagccgggagcccgtgtgttagtagggagggaaaagagaagaatcaatacacccgacaacagtggttctcaaacgtgagcatctatcagaattcataaagacttgttaaaattcagattattggaccctaccctgggaatttatgattcagaaggtctgggatctagctgagaatttgcatttctaacaagtcccagagtgatgctgccattgctggctgggaccacacattaacagccacatgtaattttaaatggcagattgaacacatgcccctcacaaagtacacatacatacacacacacacacacacacacaccaataaagggagtcttttagttgcattaaaccctgcaagaacacaacaatgacaaaattttggaaactgggaagtcatgaacaagtggtaccttactgagaagattagaaaatggatctctaaaccaagtccagatccagaaacagggctggttccctctgcctgagagccccagaaaggtccagaaattgaaagtaggggtgtaggccaggcacggttgctcatgcctgtaatcccaatactttgggaggctgaagctggaggactgctcgagcccaggagttcaagaccagcctgggtagcatagcaaggccccatctctaccataaattttaaaattagccaggtgtggtggtgcacgcatgtggtcccagctactctggaagcttggatgggaggttcactagagcccaggaagtcaaggctgcagtgagctatgatcatgccactccactccagcctgggcaagcaagagagggggagagagagggagggagggaacgagagagagaaagaaagaaagggaggggagaggaggtagaagggaggggcagagaagagaggagagagaagaaagggagggagggaggaagaaaagaaggggaggtatagcaaacaggaaaattcatgaaaggtctgtttaaggaataagtaaatcctgtggctgagcccctcacccctgaagcttgctggctgtcccttatctaccatcagcacaagacttgggctctctctctgaagagactgaactgaagtctccctggtcctggcccccactggcccctcagcaccaagaatactggcaactgggcagatcatcagagaatttctctttggaggaccgatgaagagaaaattacagatacagtactgccaagtggggcacaggtgcagtgggctgagtaatggccgcccgagggtatcaggtcctaatcccaggggcccagaattgttgccttataaggaaaatgggtctttgcagatgtgatgaagttgaggatactagagtggggcagctgtcctggatcatctaggtgggccctaaatgccatcgcaagtatccttataagagagaaggaccaggagatttcacacacacaaaagaagagggagtgtgagcacagaggctgagactggagatgcggccccaagtcaaggaggtcccgcagccaccagaagccagaagaaggagggaacagattatcccctagagcctccagaagggacacagccctgctgatgccttgatttcagtcctgtgataccagtttcagatgtccggccttcagaactgtcagagaatgaacttatgttgttttaagccaccaagcatgtggttgtttggttggttggttggttttgttttttacaacagtcacagaaaattacagctagtgaaacaagcaagcaagctacccaccagccaatgtgttacacagaactttctactggcttcttaatatcccagtcttaaaatatgaacagacagccaagaatcaacaaacatttaagaaaatattctaatctgaagaaaacacacatataaaaaggaacttgaagaaacatgtagaaagtttaggaaaactttctaaaaaactataatatcctccaaaagatcagaaaaactattgcaaccataaatggaggacaaaaggttattttaaacaatactcttaggaggataaggaaatccaagtgtgataagaggtggcctcaaggagataggcatggctaccctgaagcctgtgtgggctgcgtgttctcactttcttccaaagagtacagggctgggtcagaggggaaaagagaaacttcacagtggagagacctgacaaataacgacctcagccaggtgctcaaggtcaacctcaatagtgataagtctaggggccaagcacagtagctcatgcctgtaatcccagctctttgggaggccaaggtgggcggatcacctgaggtcagaagttcgagactagccttgccaacatggtgaaacacatctctactaaaaacacaaaatttagctgggcatggtggtaggcccctgtaaacccagctactcaggaggctgaggcaggagaaatgcttgaacctgggaggtggaggttgtagtgagctgagattgtgcaactgcactccagcctgggtgacaagagcgaaactccatctcaaataataatagtaataacaacagggctgggtcatgttgccagtatgttcccctgatgtgatgaaaatggtactttacctctgtggtcttcttcctccccacatcccgtaaccacagtctaatcatgagaaaaacagacaaatcccaattgaggaatattctacaaaatccctgaccagattctcaaacctgtcaaggtcataaaaaacgaggaaagtcggaggtgttgtcatagtcaagagaagcccaaagaaacaagacaattaaatgtaatgcgatatcctagtaggactctggaatagaaaacagagattcagtgaaaactaaggaaatctgaatgaagtatgggctttagtcaataatgccttaactgtggttcattaattgtaacacgtgtatcgcactagtgtgatgctaacagtagcagggatcaagtgtgaggtataggagaactccgtgtattcatagtttcttccaagtttgaactgttctaagaaaaaaatcttattatttaaaaatttgatgacagaaatgcaatgaaaaggatggagtgtgaagctaaataaaccttccagaaaataaacctaaaaagagatggaaaatataggaaaatataataattttttatttaaaaaattaaggggtagaccaaaaggtccaatttagctgacaaaataggagtcccagagagaaggaacagaggaaatgaagagaataaagacagcagagcaatcattcaagatttcctagcacaggacataaatttccagaatgaaagaattcaccaagtgccaatcaccatggggaaaaagggcatatcctcggccgggcgcagtggctcacacctgaaatcccagcactttgggagaccgaggcaggtggatcatgaggtcaggagttcgagaccagcctggccaagatggtgaaacccgtctctactaaaaatacaaaaattagctgggcgtggtggcgggtgcctgtaatcccagctacttgggaggatgaggccagagaattgcttgaacctgggaggcggaggttgcagtgagttgagattactgtagcctgggcgacagagcaagactctgtctcacaaaaaaaaaaaaaaaaaaaaaaaaaaaggcacatcctcaggccaatggtgataaagatcctgcaaacttccacaaagaaaatttaaaaattaatagtaaaaaataatagagataaaagataaggaatccaaatggcatcaaattgcttaacagcaccacaggaaacataagaagacaatgcaagaatgaaaaacctccacattttgaaagcctggagctgagatcatgtcataagatggtgcggccacaaatagtcagagctgcctttctgaccagcattagataatgagagcaagagcctttgttgtttttacaccagtgagatttggttttaacctaacccagtggatctctaagtgtggtccatcagcaccacctgggaactgcgaatcctcggcccccacctcaggcctaatacaacagaaactctaggggtgggactctgcaatctgtgttttatcagatgattctgatatgcagggaagttagagcaccagcaacccaggggatccagagacagagaataacttaagcaattaagtaattgtcctgaacacacacacatcctgtgacctaacgctcctatttttaagtaaatacattagagagaagatgacacaaatagacttgggcgctggatgttcacttgcaacattgtttacaatagagaaaaagcaaaacaaaaacaaaaataaaaacaaaacccaacccaactacccctcaactaggagatggaaaaattaactgtggtttacttacatcatggaaaactattccgcagtataaaagaagacaacctacatatatcaacatagataaatctcaaaaacagtgttcagtggggaaaaagcaaattacaaaaaggagtaggatatcatttatgtataactttacaatataaaaaatgtctataacacagtatcgtttgcgctttcacgcattgtttaaaaatgtgaaacatacaattgtaggatacagtctaacttcaggagagcagagagagggaggtggggtctttctgtctctaagtcttcataaagaaagggagagctgacaagaataagacaaaagattaacatctagatacatagataactctgttcctttttaaagttttgactgtttcacaattggaatgcttaaacaaattatatagctgcaaggattaggaagtgctctaagacaatcaggcagaaagaggaggagctggggtttttttggcaaaggtgggcggggggaagctccttaccggaggtaacttcaatacctgaaagaaagggcaggccttggaaagatctgagagaaaggctttccagactgcaggaaaagccagtgtgaacagccagaggcaggaaggagcctagcttgcttgctgaggaatgaaatcaagtcctgatggtcggagctaagggagcccagggccaataggggtggaagggatgggtcagaacacagacggccttggaactcagatgggggatgtggattttattctaaacaccatgggatgccggttgaagggttgtaagcaggagtgtgatatgatctttgctttataaaaaaaatctctctgccactgaatttacactagaggtgggtaagtgaagaaagaaaccagttaagaaaatcctgcacattgctagctgagagaaacaggagagcgatgtggcttggtggtggcagtggaggtagcgcaaagtagtcagattcaagatttttttttttttttttagactgtcattctgtcgccccggctggagtacagtggcgccatctcagctcactgcaacctccgcctcctaggttgaaacaatcctctcacttcagcctcccaagtagctgggattacagacgcgtgctaccacacccagctaatttttgtatttttagtagagacgggatttcaccacgttggccaggctggtctcgaactcctgacctcaagtgatccgcccacctcagaccccaaaatgctgagattacaggcatgagccacagcgcccggcctcaagatctatcttgaatgtagagttaacaggactgctgactgttggatgggaagtggaggggtgtgggataacggagtcaaggatgactcctgggttttgggcttgaacaaatgcataaccagaggtgctgctgagttgggaaagaatgaaagaggagatggtgtgggttcagaaggagttccgtttgggcatgttaaatttgagttgcctattaaaataggccagtgaagctaatgagtgggcatctgatagatgaaactaaagatcagagaactgtatgagatcttggtgtatgagatcttggaatccactggatggacatttaaagatattaatttttggctcccatttttcctaagagcataacctctatcacacctggagaccatcttccacaatgtttttttttttctttaatcataacctcctttcaggttatgattaaggagaaaaatgtagcttttaaaggctgatacagaacagcttgatattttaaaatcttttatcagattatcttcatcgattcaaatgtttaacagtttaatcagcaataatgtttgctattatttctatcaatcattccaggcagagcaagtttaataccaaaagaaagtgaagtttaaaaatatatatatacacatatatatacgtatctatatacacacacatatatatacgtatatatgtatatacacacatatatatgtatacatgtatatacatatatatacgtatatatatacatatatacgtatatatatacgtatatatatacatatatacgtatgtatatttgattttaaatgctctggtgcaaagctttgggcttttgtcgctcctgtttagggcaggcttataggtgatgaaagaaccatctggcatacaaaatatagatttgcctcatctgtagggtttctagataaaatacaaaatggtcagtgaaattgaatttcagatgcacagcaaatagttttttagtataaatattggagcatacatatactaaaaaaactatgtgttgcttatctggaactcaaatttaactaggtatctggtattgtttgcaaatatgaaaatcctacttattcaaaattgtcaaagttctatgaccaatactacttcttgctcccttgaactctaaactaagaaaataaatattcatgtgcagttctattagtgctctcaaaggatgctataacctatatctatctagaaaaacagaaaacatatagctataattctttaggccttactgccagtttcttgttcatttgattttgcctagttagttttgccttgaagggaagtaagatcaccaaacagaaaggaataatatatgtgccaggcaatttgtaagtagcaaaatcaagagatctccaaacagaaaggaataatatatgtgccaggcaatttgtaagtagcaaaatcaagagatctaataatgtattccagtctgtctcggattagttgtataataacctgtgcttcaaccttctcacctgaaaaatagggaaaatatctttgcccaatccttctcacaagagtctttgaaatttcacacagatgatgacaataaaagcaccccatgtttcttagaagatgaaggaactattgttctctacaatttttgtggtaatatttgctaacctcagaaaactacaatcacactaaaagatagtctttgtcaaaaagctgatcattaggtagtggtttaaagttttaatcaaaatatcaaaggtgattcttttagaacacgaagaattcatctcataaagcttttaaaaaaacaaatgagaaatcaaatattttttaaagagaaatagagaaaaatgccttttcagatttaagacaaatacacagaaagtaaaatagaatggtatcaatgcaagaagcagacaaatagatgaagtgaaaatatagccagaaacagacctgtttttaatcgtgagtcaatgggtaaggaggaaattatcttatgcatagtgttggaagagtagttatttgaaaagcaaatcaatttaggtccttacctcacactagacaccaaattaaattccaactagatttaagaagagagcaaaaacaaacacaactagaagaagatagcaaatatttatctaatctttggtgaagggaagattgtataactataaaataaaggaaatcatgacattaaaaaaataggtttgactatctaaaaataaaaatctttctttggtatgctaaaaagtagcattagaaagcaactaaggccaggtgcggtgtttcacatctgtaatcccagcactttgggaggccgaggtgggtggatcacctgagatcaggagttcaagaccagcctggccaacatgacgaaaccctgtctctactaaaaatacaaaaattagccaggtgttgtggtgggcgcctgtaatcccagctacttgggaggctgaggcaggcgaatcacttgaacctggaaggtggaggttgcagtgagccaagatggcaccactgcactccagcctgagtaacagagtgagactacataaaaaaaaaaaaagaaaacaactaataaaagtatttgaattttttataaaaggttaacatctctgacatataaagagtgcctacaaatcaaaaagaaaattgattgatagataccaatttgtcccagcagataaaaatgggcaattcataggaaaaaaaagtgaaatgaattaataaacacttgggaaaacatccaaccatgtgaattatcaagtcaataaacataatttaaaatattctaccattttttcccttaaaatcagcaaaagttgtcattattattaagaatactcaatgctggtgagtgtgtctaccacgcttttacatggtgctggtagatgaacagagtaacacatttggaaaccaaataatatgcaccaagaatttgtcaatattcatagtcttttgatctagttattttactagaattagcctacattttaattcagtaattaccctgaattactagattatcctatctggattcaagatctatcttgaaagttataggactgctgactgttggatgggaagtggaggggtgtgggagaatggaatcaaggatgactcctaggttttgggcttgagcaaatgtataaccagaggtgctgatgagttggaaaagaataaaggagatgatgtgtgtacagaaagagttccatttgggcatgttaaatttgagttgcctattaaaataggccagtgaagttgatgagtgggcatctgatagatgaaactgaagctcagagaactgtaagagactatgaaatcagctggctggacatcctaatctagtaattcagagactttatcttaaggaaatcttccttttaaaaaatgcacaaagatgttcattatagtattttaaatattttgaaaactgaaaacaatgtggaaatgataaggcaaaccaactactcaatggaatgttttacagccattagccattccaaatgttatttatgaaatggactggcatggaaaatgtttatgatataatgaaatgtgcagaaaagtcaaggttcaaaattgcatattgaatataactgcaaataagtgaaaaaaaatctcagcacagaaacgacttaaaaatcaacaggggttgtcttttaagggagcatcatgtgtagtattttcttattttttaaatttttctacattttaagagttctatgttatggaaaagggtataatgggggaaaaaaaggttgaaattgtatgtctgtgtgcctgtgtgtgtgtgtgaatgtgggtgggtgtgtctatatccatctccatgtcctctgtcccatgcccaggtcctttggagtgctgctatgggaaatcttttctcttggatatatgccataccccagcaaaagcaaccaggaagttctggagtttgtcaccagtggaggccggatggacccacccaagaactgccctgggcctgtgtatgactcttttaggaacacttctgctagttactaagcagtttttcttttcaaaaaatatccagagccacatatgcttctttaagatgaaggggcagatggctgccctccctttaatatgccccaagatgcgaatgtgactgcgacttcagtgagatggatgcgtctcccaggccctcaaaagcaaggatgccatcccagaaaaagtatccattgtctggctacaggctgtggactcaccaggcctacattccccaagctcctgctgggaatgtgtgtcccaggcccagtccctgctgccctacaccgtatgtctgtgtctactttaaagatttccattccctgcaatgtctcctgccctgcctggcacccctcacttccttcccacaagcaacgtggatgggaaatataattggaatattctgtccccaaagtggctttaactcaggaatggagtgacagcagccgtggttaacataaacatcaggatgtctgtgttagatacctttacacctgcgcactcttccttgaccaatcagcagggggcagcataggccaagtacacggggcctagacgagttcgcaccctcaacgtattcgttgcaaccctggggctggaagaaaatatatttttcatcattgtgcttctccttattttaattaatgtgcttcttcttttagataccggataatgactcagtgctggcaacatcagcctgaagacaggcccaactttgccatcattttggagaggattgaatactgcacccaggtaaaacattttctccctttggtcaacatttactctatatgaaacagtcttaaagatggcaaataccgaaatatgaaataggtcaagccagtcagagtacaagatttatgatcaaaatagtgaaaattaattttctctaaaatgaaatgactggtgtctccatttgcccattttgtaaaataaatattagtaacttcaccagcacacagcacagtgccagacacacagtaaaaactggggaatcaatccagtccacgagaatttatcaagtccctactggggacctaatgttttagtagccaaaattgaagcttcacagacgtatggaacacatctgctctcaaatagtttagagcctggctggagaaataacaacatgtgaagtaattaattgcatataaaattgatagattatatgtccaactatatatgtcaggaggattaagggaatgaaatttcaaagtaatctggagaaattttaacatcatcaataatacttgctatcattcatactgcacaaatcactttttgcgtatttcgttttatccttagtggggaatgtaaaatatccctaccttatagatgaggagttaaggcctgaagagtctgtccaagtcaaacattcttctagcaatcctgtgggttcctctacagatccctctcccattccttcaataacgactcgaaatttttgcttctctccctcattttcagccgacagctatgcttcctccctcaccaagagggtggagatcatcataagagaatgccctcatttcctccctgtctctgatacaaacttctctgcctctgccgccatttctcaccacctgccttcccgtctctcctccccttcaaggccagccttgctgccagtatcaccaatcgcctgctcagggctttgttctgtccgatgctctcctcttccctgtattcactttctttccctctctcttggttctcgttctgccaggatatctaattctgagaatattttagaagagtcaataaaccactatttatttaatttaattttgggagcagtctcgctctactgcccgggctggagcacagtggcgccatcttggctcactgcagcctccacctcccgggttcaagcgattctcctccctcagcctcctgagtgaccaggattacaggcatgtgccaccatatccagctaattttttttgtaattttagtagagatggtgtttcaccattttggcaggctgatctcgaactcctgacctcaagtgatccacccgcctcggcctcccaaagtgctgccacacctggcctacctactatttctttaaatcccctcctcttcattgtgactaaagacagacacatttttcaaactgtagtcattttccagcctcactactccatcctcttattcctttcagctcacgtgagtgaactggcatttttatctatagacttcctatatcacgttattgaaggttctttcagagaactctgtttaatgacattaggttattttgttgtaatctgaatggaatacacccacttaaacatatataccttcttaggagtatttttctcaatagtctataatatccctcttaaaaggcagttttacacaagcatatttaaaatgattgattcactatagaaattactaaaacacagagggaactaaagaatgttttaatgagtcagaggtagttattttttaaactcgaacactcgtgtttttctgttactcaggtaatgagggtattttctcaatttgcataaaatattaattaatttctccaaatttaatttttcttccacaaattttccctaaacttctggcagctgcttctgttcttctatgttacagtctattactgtgaaaatgatctagcacacagttgtttttgtaaatggttttcctcacagcacttcagcatttcctgggttgtgcaaagggtccctcacatccagactagttaaagaatgcctgtaatcccagcactctgggaggccgaggcaggtgcctcacctgaggtcaggagttcgacaccagcctggccaacatgttgaatgaaaccttgtctctactaaaaacacaaaaattagcgggggtgggggggtgggggggtggggtgcatgcctgtaatcccagctactcaggaggctgaggcacgagaatggcttgaacccactaggcagaggttgcagtgagccaagattgagccatggcaccccagcctgggcgactgagcaagactgtctctaaaaaacaaacacaaaaacatgcactgtggtacctgcacatgtgatgatgtggcacaggaaaacttacaatcaagtgtaaagtacccaaatggaaatggaaagcagctgggaagagatcaaaaaataaaccctgtaggccaacatggcatgtgtctcctctcctcctccccccagccccccaccatcactcttgaagtcaaacacataggcttttatttttattttttccagttggaacgattttagtggaactagactggaataatacaaataataatcttaattttttttttaaatccactaatctttaaaaactggccaaaggtctcctcctctgcaaagcttttcctgctccactctgtcccaggcacccatacacacttccattatagcgcttatcctctaaggtctttgaggataaggatgacttcccattcattttgtatgccccagtgcctgtaagttactatattctcaataaatcctggtttcctcatctgtagaatatgtttagataacatcatctctaaggtatcttctagatccaacattttttgtctctgattcaaagttttaataatttcccctacggcaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaa

SEQ ID NO: 2 - DNA, 47434 bp, Homo sapiens
  misc_feature: KIF5B
ctcctcccgcaccgccctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcggtgagtgacccccgccggcatccctcctcccgcttcttcgggccggcctgtgcggggagtttagggaagtggcagggtgcagaattgaaagggagcggcggtgtccccagccctccccggcggggtttgccggttcagataacccagtggagggagactgcgcagcctcgcgtgcgttcctggatcgcccccaccccagtcttcggcgccgggagacgggaagcgcccagcctcagccctggacactcccccacctggggcaatggaggaacgtccgggcagcaagttcagtgcacgtttgtctgcgtgtgtgtgtgtgtgtgtgtgtgcaattacggatactgttggtgttttggattaaccccaaatttgccattcagaaaatatgtaatgctaatataaagatcggctggtgacattgagctctgagataagccgtagtgtactttagtaaagatgcttagttttatggaaacataaccagtccttgaaccgtattgtttccctctgggagaaggaaaaagcaccaaaaagaggtacaaatattatctatacctccaactttcacccaccactttttgagtgatgaaagacttttcatgttaacaactacaaatggcaaatcgatgattgtagaaagaaatagttgagcttttttttttttgaaacaggatgatcagttttgtttaatctagcagacctagccgactttggttgggtcagataagtgctccgaaagacaaatcgcattcttgctaggttttatgggataacagcctaggaaaaagtattaactttttgtttttgtatcagacagaaagtgttataaaaacaaacttataaaaaagataaaaattgaccagtattagattcatacttctgcagttaaggtctatcttgaagaaaattgttgtttggtaatcccaagaatagtgagatactgtttttttgtaatgaaaaacataactagagttgagtgatcattatcagtgagaccagaatgtgagggtttttaaaggtctgatctctggcattgaaaggtgtgagaaaatagcactcctagttgaaggagattaaaaattaattgtaaagtatggcatacgaaacagtgactaaattatgttgctctttgttggtaatgctatgtagtagaactaactttctacattgttaccatggtatgaaattttaatatgttaatttttcctctaatgtcattctatagttaatactgtattggggctatttaatttggaaatagggcagaggtcacaggagatgggacatggatgattgaaagcattgacactgaagacagactaaagttctttagggttttgatgtgaaagtttctccaaagttcagctccaaaaaatgaattgtcttagctccttggtaggcctttggcaaacaagtcattaggccactaacaattgccaactattactgtgtaaagactgtcaggcgagttctttgttaacaagtccactagaaaaactcgtgtgtaaatgacatcatagcccggcagaggcggagtagttaagcccagtaatccttttcctttgggatggtatattttacatatagtcaggaggcttgcaaggcctggattagttgtcaaacttgaggctattagtttcttaagagtttttgtggtttacagtactcagcttctgcagtggttggcacatcaaacctatttttccgtttacacttgttttaagaatgtcttatttcttcagattttgtgtttacacagatctgtagttatcactatgattctttttgttggaatgctaaaatttaggattcataaaatgtactaagattagaaggtaaactttgatgaggcacaaatacgacatgaactatgaagaaagaactaaaggaaaatgaacaaaggaaacatacatttattctaggtttccattgggaaaaagttgcttataagttccgtttcaaaatttcagtactctatataaatggtaatattaggaataatggatacattgttggtttgtgaatccgtaatgaacagttaacctttaggtaagctgataagcattttagttgttttttggttggttggttgtttttttgagatttttttttttttttgagatatttttgagttttgctcttgttgcccaggctggagtgcagtggggtgatcttggcacactgcaacctccgcctcccgggttcaaacgattctcctgcctcagccgccccagtagctgggattacaggcacgcgctaccacgcccagctaatttttgtatttttagtagagatgggtttcaccatgttggctagggcggtctcgaactcctgacctaaggtgatccacctgtcttggcctcccaaagtgctgggatcacaggcatgagccaccacgcctggcctggttttttttttttttttttaacgtgtaaccaaaaatacattacaactgaataacatagccttaaaaaatgaaaggcaacatgttttggttcattgttttcagaaactagtttcttgcatatagtaacgacattaattattgaggtctcatatttttgttcagttttttaaatgaattatttcattttgtaaaaggttataagagcagccaggaggagcggaattggaaaatctgtgggtaaaatcttctcggtttggttttttcattttactggttcctaatcctgattcataatgaacagtttaggagagaattgctgcaatgcagcatttaaaactaaatttttaaaaacatgatttaagaacattttgtatacaatcttctatttagatcaaaattgaaagaatattgtagtttatgatgttagaagcataatcagtgctcatggagaaagtaatttttaaggattctgattttcttataacttgagtttttaatactttgtctaaacttttttcctgctactcatgtaatcagtgattttaatatgacaccatggcaggcaaatctttcatagtgtttctgtgtatgctgtacagcctttaatacagaatttatttttaattaagtgcttggtgaagtgctataaatgtaacatcgaatgaaatgaattattttatgaaagtctttaagcgatatacatataaactatttgctttaaattagagaacttgttaccgcaaagcaaggaggacagggaaacagtttatgtctttgaaatgagcttgctggaaacaccagaaaaaaatcagtagaaaaaattaggagcttgctaaaaacaccaggaagaaaaatcaataaaaaaattacatctatctatttatgaatcatgaaagtagaatatggttatttgcatcattaagtatctttacaaatcattattccttatatggtacaccgtaaaggctgccaaaaacaagctgtggtagttccgagaaattagaagagaataaaactaattagataatcttgcccagttccttgcctaagcaaaacaacattctcgcttttcaagtgaatgatttggtgtttgaaccttcttgattaccttaagagggaaaaatgaaggagaggagggaaccatcatcacatacctttacagttgtggaatgttagcccactatagtgtttaactaaggaaaatctaatataatacactcccaagtgatctgaaatgatccgctattcagaattccagagaaagacatatccctgccagaagggtgtccttcataaccaaatttggtcttcagtctggtcggtgcatactcaaacaggaatcacttcccttaaggaacctaaggtatgcagttgagatcaacttattcctttttgatttgtccccttaaagcatcaatcagacgtgaatgcatcttgtgacttggagttactagtaatattgaaatctgaaacttgggggatctttgaagacacatgggattaaaagctgcataatgtacatttcgaggctaaaaaccaggtttgaaaaatacagatgtccagatgagtttttctttaatttatttgaaaaatagagatatgccttaattatagaccattagaaataatttttgtgtttcacagagtcttgattttcattccaggaagccagagtcagtaatttatggctagatctttaattaaaacatttgccttacttagtattacaaaatcatcatttggttttgcaatcaagataagactgttttgtcaacttaatgctaagcacttaatttttatttaacaataacttctagaaagataatcactccagtctcaattatttttatgtttgtgtgttaccttttaatagttgccatttatattattttagtaaggttgtagtggtagtttatatatttgcttggagttgataactagagtaagcagcttcataaagtacttctgaaggcaggctttactattaaaactgtttactattatgaagctgtttacattatttctggcatatctcttggtaaatggtttaggggcactattttctattgatgtaaaaattgaggccaggcatggtggatcacgcctgtaatcccagcactttgggaggctgaggcaggtggatcactggaggtcaggagtttgagaccagcctggccaacatggcaaaacctcatctctactaaaaatacaaaaattagccaggcgtggtggcacatgcctgtggtcccagctactcaggagtatatttgtagatacatataaaattctcttgacattacttgatcacttatattagatccaagtgtataacttaacttagtattcaggtttttatctggccttatcctctattactctttgaaccctacagtctgtactaattatttctaaaattgtgttactcatctacaatatctcatatctttatagtcactaaatgaatgtctgctggataaatgagggaaaattactttctttttgcatagaaaaaactattagtatggtttgtttttgggtggcgattgttattttgattgtacttaacgtttgttttcagaattgttcaccatgaatatatcttgtgtcagcagtaaaataatagatttcttttagtcacacctgtagaattgaatgttaattgtttcagtagcatctgagaaaaggatacgttcacatatgtcacaactaaagaataatcagacatcgatgcctattttaaattgatgccaaagtgagatcagcttcttgtatctgtcagtaatgctttcagctttagaggaaaaaccaacagctaatagtggcttaaataaataagaggatgtttttctcacataacaaaaagcctggatataggcccttcacggttcctcactctgttatactttgtcgtccttagctgttgcttttcatcatcctgtttgtcgtatttgcaagatggatgctacagctccaggcattcattccaggaaggagaaagggcagttttagctgagatggtcctttttatcaggataacaacacccttctcagagacctcgaacagaccgccacttcatattattcagagcttggtcatgtgactactagttgcagggagactaggctaacaggtatttggctttccggcctatttattgggaggtagcaagggaaaggggaattgggaatggctttaggagtgtctggttcattgttacttttatttcagactttgaagtggggatgtggagggtagtaggtctttttcagctaagacttaggaagtgttttctaatgttaagggctttttctggggtcatgattgttttgtgttttagggcccaacttccttcctttcctttaggagaaactagagagcaggcagatacttgcaaatacctagaaccccttgcctcttatttttggatacctactctttctcctagattattaaaattgttcctgcaagcatttaaactacctcaggtcttacaagtcttaaaaaaaaaataactttcttagacatacagcagattttctgcaccacttggttacctcccattctttttcaatccattccaatctgacctttgtcattgagtactttttagttttgtcttggcctcacaactgtatttgacataatcactccctccttgaaaattattattttttgacttgcatggacaccactgattttttttttttgttcaatacccctggctccttctcagactatattagtggttctctgagagtggtccatggagtccccagtatcatttctggggtccagaagatcaaagctgttttcagaataagatgatgtctttttaaccgttttgatatttgcatttgatccttgctccttgtacttcaacttaacaacttccattggtttcttgaatgctacactgttctttctgccttaggatctttaagtatcctcccagtgcctagactactttcctacacgaaacctttttcacccttcatgactaatactggggagagtgatgatgagttagttgctgcgtatttttcagttcttaaatattctttctccaagggtgtttccgtgatattctgctttcccgtagacttaggttctcctcctatattctctcattgcactttcatagcactcaattgcatgagtcagaattctggtcacttaattttttaatgtctgccccactattatttatgctccactaaagcagagagggaatctcttggttatcattctagcatgtcatctcacattccataagtatttgttaaatgaaagaatggttgaaaagctgttgcaggacaggcatggtggttcacacctgtaatccgagcacttggggaggctgaggcaggaggatctcttgagcccagaagttcaagacaagcctgggcaacatagcatggtggcacatgcctctagtcccagctgctcaggaggctaaggtgggaggatttcttgagcccaggaggttgaggctgcagtaagcagtgattgtgccactgcactccagcctgggtgacagaaccgagaccctgtctcaaaaataaataaataggtatttaaaaaaataaaaatcactcagcaatatttggctgccatagtagtgctaattataattactgggaattataattgtaattactgggccctgggaatgcagcaaagactaaagaccattcttgttttcctggagtttattctaatggatttgtgcatggtgatcccttctacttcaaagattcaatgataccaaattatgcatactaggtatactattttgaggattaaatatattatatgatggcatctgtaaaggttagaaatgttcatttacctttaatttgtatagttgaaacacttttttgtttttcagtccaagccttatgcatttgatcgggtgttccagtcaagcacatctcaagagcaagtgtataatgactgtgcaaagaagattgttaaaggtaaatatattcaacctgctgagttgtctcagcaataagtaaataagtttgtgatcttttctacttactcagcttccttttttcattttaatgcccctttcttctaagttaattgcagaagaaagttgtttaaataataaaaaggtcaaacacaattagtaaatattctattgctcaaattccatgatctaattatatacagtacctaattaaggttattatgagaactatgttacacacttattcttaagagatgcatttctgttagatattcccaggagagtttccaaggtggcagttctagaaagagaacagtatgagaatgaaaacaaaagggctagacacatttctaaaaagtagtggaaaatggcagtctatcattcttccattccattgttattccttccccaaagacttacctatcccttgaggaatttaacaagggttgccaagggtgagaaaagtatgtacattccagttaatactataacttatacaagaatatttataactttatatattctaaaaccattgaattttaaagctgagagagtgctcattgtttatctggagttacttccagttactgtagaaatctgtttaatcaaaggaatggctgttactttgtgatatgatttatttcattttttgacagctgtagttgttacaaagtgcttcttagattgaggcaaaatctgtgttgtggcattcaccacattaaaagaattgggattcagtataaaaataggtggattaggatagcataggagcacagatgctcatcctagtaacaggagataaagtggagttatagaaggtttatagatgaggtgagggagggaaaatgtgtatgtactcattatatcaatttcatattgtctaatacagggagcaaagtcatcatggagatgaggaagggggaagaggttctaggaaaaggcatgaaatggatggattcaggcagtgtgagagtattgccaggcagtattaagggcccactcaaggttagctgctgaaagagttgaatttttgcccatttggagttttgctaggtgagtacaaaagagggaagtgggggacaagagaattgaggatatagtcaaaggagtgattataatggtggaccatgggatctaaggtggttaagttacaggaagaaggatatgagggaggctgaagggcagtgaaaaaaggtggtaacattagtgggttgtagatctcagtggggtcaaagatttgttggaatcagggtactggacggagtaatagaaggtgaatacagacagtccctgacttagaacaacttaaaattgttcgactttacgatggtgcaaaagcaatacacattcaatagaaatattcaatagaaatatttctagtacctgtacaaccattctgtttttcactttcagtatagtattcaataaatcatatgaaatatttaacactttattataaaataggctttgtgttagatggttttgctgaactgtagatcagtgtacgtgttctgagcacatttaaagtaggctaggctaagccatggtgtttggtaggttagatgtgtttgatgcattttcagcttagggtattttcaacttacagaacatttatcaggaagtaaccccatcgtaagttgattagtatctctacttgaaattgagattatggaagcaatgcagttagtaatgaaaaggtaaaggtgttgtcatggagttgacttccgaggtagtaaagaaaggataaggccagacatggtgggtcacacctgtaattccagcactttgggaggctgaggtgggaggattgcttgaggccaggagtttgagaccagcctgggcaacagcgagaccccatctctgtttttaaaataaaaatgaagaaagaataagatcgcagaaaatttggtcaaggagctgagaggccaggttattttagtgggattatctgctacagactttgaaaccaccagtactgttttattacaacagtaatggtattggtgagagagagtgaactgggtactgacatcttcataaaatgaaggggaattaacacttgtaattgtgtaaatgactgcaacaaagaggaacagggtcatcatgttgtaagcatcatgtggttttccagagggatcgatcatagaacacaattttactacattctttgattgagacatacttctgtctcatcagtacagtttaagattacattagctttctaaccaatagaaagttaccgattcatgaattcatgggcaatttgaatatacaggtcttttttgtatctcttgccgccagctttaagccccattccatacttgcactttggagagcaaacctttaaagtgcagattccattttgttcattttagctcttaatcatattttgagttttatactggggatctagtaagttggctgtcagcacatttgataagtctattaaagtgtcaaaggttttgaagtttgaaaaatatgattctaaaccatttataaagtgcttaatgggtcatggtccctaggttaatcttctaaaatgaataagattgttggcagttatttcaatcacactgtttgggtattcagccaacttcagagcctcttacctatacgattggctagtccttagtttgtcaacatactcacaagaaaatgatgaaaaacttgaatccttttatcaagtgatggtgcatgactctagtatttgcccaaagtaccagttgaataaccatatccaaacaggaaatgaggttagttcaaccatagtctttacttaataaaattttggtatacttatttccataatctatcccttttcccattttgaaaatgtaaataacattagtgtcttctattacctttgttctctttggcttttaaaagtaacctacagtagctgtgagatttttatccctggaacgtaatcctccttagtaactagaaacttgggctcatttgaagccattcttttgctatcgtactatccacataaaccttaaagtccctttcaacaatgtttattctgttgttctgttttgaggatcatatttgtggaagatggtagtaaatagaagtacctctgttttaatatcatcagttaatattttctggtctttcctaagcaatgcaggttcattcattcattattttttttctgaatatgactttaaaagttctttttagggccttagtttttattttgttttggtcttaaagttacttatcctggacttttatctttctcatgctgttctcgtgagttctgtctcttctcttgtatatccttagttacacagtctcttaataataggctgatactcagagtttttcaaaatctattgttttttaagtggtacctaaccttaaggaaaagaaaaagatgaagtctgttttcctgacgtttaggatacatgcatctattacttttgttctgttttattactatttgcagttctaagatgaaatcgtttgcttcctgaaatttctcttcttttctcaaaatttcagtcccttcttcatcctgctttactgtttggaactgcgttcaggataatagttcccttctctgtaatatggtaagagtataatctttagaatcagacagtcctagattgaattctaggctctgccactttcttgctgtgtgacttttggcaagttacctaacctttccaagcctccatttcttcttgtgcaaaataggtactaggagttgttaagcacaatacaggtatcagctgctaattgtgtcctctgtcgttgtcttctttttttttttttaaattgagacggagtttcgctcttgttgtccaggctggactgcagtggcgccatcttggctcactgtaacctacctccgcctcccgggttcaagcaattctcctgcctcagcctcctgagtagctgggattacgggcatgcgccaccacaccctgctaatttttgtgttactagtagagacagggttcctccatgttggtcaggctggtcttgaactgccaacctcaggtgatccgcccaccttggcctcccaaagtgctgggatcacaggcgtgagccaccacgcccggcatgtgtcctctgtcttcttagaggacattattaattcaatcagtcgtgtttgtatttgggataaactcatagtctcagctatttctactgtacaaaattagacttccagcaagtgttagaatacaaggtttctatcataatctctttcttcttctatgcaacctttgtaatttatgtcagtatcacctggcgatgatttccttttatctttacccaagtgctctgtaccattttggaggagactgcatgtagtagctggtgggacttgtcctggacaaggatatgaatgtggcagagttaccaataaatacacatatttaaggagaaagatggcgtaggggtaggtcgtgggtacctagggaggtgtgaggacaggaaagcaattaaatacatggtaggttgtacttgggacaatcattgttaaacagattggatgagaagccatggttagaaattgttggtaggcaaagatcagcagaatgatgggccagctgggatttcttttgagatagggatttgatgagcaagttgccagtaatgacctgaaagcagatagtactctctgggtccccgacaagttcactgagaatgcactggctcataattatctggacaagtttataacttgattttatgtagggctattaacattccctatctgtagatttgttagatacaattgttacttttgaataaggtttatccacttgtattctcttgaattctgaatctgagtgatttgtttcccttgtgttaagtagctatttattcattgcccactatatgataagcatctcatcaggtctttgtagatttcctgttttttccaccatggcttcctgacctgaactctctgccgctgtattcacctttggtttttccagatgtagcctaccttgtatttattttggttcctctgctccttgagtatatagtacagtggttaagagcaggtctctggaaccaagtctatttgcatttgcgtctcagcttcatcttactagctgtggagttacaggcaagttatttaacctctctgtgtctcagttttctcatctataaaatgggactaataatagtacagtgcgggctgggcgcagtggctcacgcctgtaatcctagcattttgggaggccgaagtgggcgaatctcctgaggtcaggagttgaagaccagcctggccaacatggtgaaaccctgtctctactaaaaataaaaaattagccgggcatggtagcacatgcctgtaatcccagctacttgggaggctgaggcacgagaattgcttgaacctgggaggcggaggttgcagtgagccgaggttgcagtgagccgaggttgcgccactgcactccagcctgggtgacagagcaagactctgtctcaaaaacaaaaaactaatagtaccgtgcacggggttttgtgatgattaaatacaataatatataaaaaatggttagaacctgactcattgtaagctctcagatgttaatagtaactttatatgatgacttctaattctcagagcttttgcctaagtagtcattttgctggggaggctgaagttcagggagatacaaagtgactttctacaacgtgatgtgctgttatctcactacctaaatatgttttttctgttgatacagtatgaaagaagtaatacttgttcagagttgtccacctctgtttctcataggaatggcaaaagtatatttaaaagggtgagggaggctttagaaagatgctgtacattgatgatggtaataaatattcagcaagcatttgagttcctctggagtgccaggcactgtgttaggagttaaacacggtcctgactttgagttgacaggctagtgagtaaagcagacaggtaaattgatcgaatactcattggtaagtgttatgattaaatgcagatactgtaagaacacataggatgagacttttacccagatattttgggggtgcgttgtggaattgggttagaggaagaggtaaatgtgatacatgaaataattttgctttccttctcaaaaataaaaagattttgaaggaaagtttcaaatgtttggagtctcttaaaatcttcccagggaagttagtaatgatgtctttttttctcattaataaatgtttctgtaggaaatctgttatccacttagttgtgcccatgttggggtttttttttctttttaaaataatgaataaaaacaaggattggcttgcttattagtttacttttcactgttatatgctgtttccaacagaggcttctctttttgttttggcttcctctagaatagaatgtaatttcatagtacctttcttgtcaccaaaaacaaacaacaaacaaaatcctcgaaagccagaaatcaaaggattgcctttttcccccctttgacctaataaaagaatatatttaaatgttaatgtcagaggctagaaaaaaatttcataggagggtcaggtgcaggggcttacttaggcctgtaatcccagcactttgtgaggcttgaggcaggagggttgtttgagcccaggagtttgagatcagcctgggcaacatagcaagaccctgtctctacaaaattttttttagaattagccaggcctggtggcatgtgcctctagtcctggctacttgaagctgaagcaggcagcttactacacccaagaggttgaggctgcagtgaccagtgagctatgattgtgccattgcactctgaacagaggggagaccctgtctcataacattttttttcataggaacttcttggtaattgattttgaggtaggagtgagtgttacactttgtgggtaggataaagaggaaggtcggggtttgtgaggattagctactaattaaccatcaattagtcttgtttctaaaatctcatctgtatgtaaattggcagaggattttttttctttttggtcacataaagctttggagtgtagatgtaatgacatttgagatgtacactgatacaagagattctttattataagcagtggaatttaaaatttgtttcttaattaaccacagaaagcagtctgggtccagagaaaattgcttagatgggtcatcactaagaaaattactgttgttatatatttcctttaatgtctttataaatcctttatgtactaaactttgatggagtctttcatattagcataaagaaaatctgaatctttcttgccactctttccacaaataattttggttttttttttttttttttgagacagagtctcactgtgtcacccaggctggagtgcagtggctcgatctcagctcactgcaacctccttctcctgggctcaggcgatttttgtgccttagtctttcgagtagctgaaattacaggccacgtacagctaattttttttttttttttttgagatggtgtcttactctgtcacccagactggagtgcagtggcgcgatctcggctcactgcaacctccacctgcccggttcaggcaattctcctgcctcagcctcctgagtagctgggactacaggcacgcgccaccaagcccagctaattttttgtatttttagtagagacagggtttcaccatgctgaccaggcttgaactcctgaccttgtgatccgcctgccttggcctcccaaagtgctgtgattacaggagtgagctaccgcacccagccactcccacaatattttattatacagaatttagtatgcaagggttaggaagagggtgtgtgtgtgtgtgtgtgtgtgtgtgtgtgttttagggtgttttatacctcactaggaataaacatctgatattttcctgtaacattaagtaattttttttttaaccttttctctaccctgtcatcctgtagtttaagtaatttcttaggaatcttgcttaaggaaaaaatcccctgaactataaaatcttttctcatagatgtacttgaaggatataatggaacaatatttgcatatggacaaacatcctctgggaagacacacacaatggaggtaacgttttataatctgtacttagatgtggtttgcaatacatacagcattcattatttgtgatattatttcaccatgcataaacattttaatttactctttattgccttttctcatacaaataatatacatgtaacatcattgttggaatctaatcagttcctgagtttaaatagtaagggatacctgtatttgagattatatttgagattgttttatcagttagcataaccataaaataaataacattttagacaagaattttttgtcaccctgttatatgggaaattttgaatgcttatgtgttgttgattttatgtagtataaataactttttcctgttctccttggctcctccttcctcaaaataactgtcactcttctctgataagaatgttgccataattatcagtgctgctgttaataatagatgtggacccactatagctttgcttctagaaaacagcctgtgattttctgccactgctaaagagcatctgtttttatcatttatttgagtgtactatattaagtaaatgactgcttcttttagtgtgattcatattactgattttcataaagtcatagagaacaaggacatcctagtatttgcatgaatttgcctcgaagtagaaggaacaatgtagaattatatggaaagaaactaaaacctttttaattatgttcattttacaatgaacattttacaagcatggataatctaaatctagtgattaaatgaagggttaagatctgttggtaacccatgtggttgatgtacagtactgtgtatgtgtaatagttgaattggattttttaggtatttacagagccgtttccacaaaaatatagttcctgtcctttcttgactataagttgtagattgaaactctttgtttttacttcatattttataatttatttaagaagtctagttttgttttttgtttagggtaaacttcatgatccagaaggcatgggaattattccaagaatagtgcaagatatttttaattatatttactccatggatgaaaatttggaatttcatattaaggtaaattccttgaggaaagattatattttattttacagcaagaataatgttctaaaaaaatagtaaatgctggtttctttaattttaaaaattgtttttctggaaaggtacagttgaaagatcattcaggttagtaaacttggatttttgttcatctgccattagatgaacaggaatgttaactaacgtaaatgattaagtctttagcctccttcaaaaaataaaggaggttgctttactgcagaacttgaaggtttctactacataaaactattctaattcattttagatgaagataatgtaatttatgtccaatgggaagactgcttaaataactaagctaatttggctaatttatgtcttcccattagaatgtgagctatggctggtatgttgataactgtctctctagtctaaacaatgcctagcactcagacctcaatatgcgaataagttatataactttagttgatcggtgtttttttaaatttgccctttaggtttcatattttgaaatatatttggataagataagggacctgttagatggtaagttaaattcttgctaatcagttttaaataacatctgttaattcctttttaataatagatgtgagactatttctttgtaacctatatgaaattgtcttaagttattggaaatagacaaaattttttttcttctaaagttttagttgaatacctttaaatagaataactagtttaaagcgatgtttatgggtacttcttagtagtaattagagcattggactgggagttacataatctgagccctgagttctagtcttctgtcaactgtcaattagatacattgtccttaggcaaatcattgaaccattcagggttaatgttcttgtttataaaatgtgggtggtaggttggagtggtcctaaaattctatattgttgcattggtttctatttacatctcctgctgtgtctgtaaggtctgctttagagcaatgttttaatatgtttttagagttcaactattgctgttaggctgctcaggaaagcctatcagttatttcatatccagtgttaagagttttaggagaatgttgctaacatttgtttttctttctcagtttcaaagaccaacctttcagttcatgaagacaaaaaccgagttccctatgtaaaggtatttatagtacagttgtctagaaaaccctgtaatactttttttttttttttaagacagagtctcactctgtcgcccaggctggagtgcagtggtgcaatctcggctcactgcaacctctgcctccagggttcaagcagttctcctgcctcagcctcttgagtagctgggattacaggcatgcgccaccacgcccagctaatttttgtatttttagtagagacgaagtttcaccatgttggccaggctggtcttgaactcctgacctcgtgatccgcccgcctctgcctcccaaagtgctgggattacaggcgtgagccaattcatttaatatatggaggctcgctctgttgctcaggctggagtgcatggcatggtctcggctcactgcaacctttgcctcccaggctcaagcgattctcctgcctcagcctcccaagtagctaggattacaggcacccgccaccgcgcccggctaatttttgtgtttttattagagaaagggtttcatcatgttggccagacattaacatatttttaaaaattatttcacaggggtgcacagagcgttttgtatgtagtccagatgaagttatggataccatagatgaaggaaaatccaacagacatgtagcagttacaagtaagtagaaaataacactggttaggatttaaaaccagcttaaaatatccttatccaggtgattaattataagattgcttcagggaaattgttaaggggaaatcatgtttgtttatatttgtttgtgtaatttccttgcagatatgaatgaacatagctctaggagtcacagtatatttcttattaatgtcaaacaagagaacacacaaacggaacaaaagctgagtggaaaactttatctggttgatttagctggtagtgaaaaggtaaagtcttcatgtattttgacaaatatttaagcatctttgtaaactttagtttgagttgggagttacgcagggttcattgttgcatcttacttaccaaactggatttggtaacctgagatttgtaaccgctgatgccagtgccttatgatgatatcagctgaataatcagttccaagttactgttgtttgaccatactctagttcaacccataagtggtttctatgacttaagatatgttcatagtgagaactggttcagcatatgttgttataaactttattagatatcccttttctaatttttgatacgtattttatccatattggcagtggggtccctattaaaactggtaactctcgattagtcttttctggtttggttggacttatttctttcctttggattattgtttcattattacaattctatacagtctgattctagtctatatcaaattaagtttgaatgttataatagggacctctgaccatttttgctgttgtgctaattttgtttcttctgcttagaatgatatatctattccgttctactctgaagtcttacacacatctttcaaagattatctaatctgagaaatctcctaagctatttcttcagccaacattgctaatttattgttctgacctatctttaacatagatactagctgggcatggtggcacatgcccgtaataccagctactggggaggctgaggcaggagaattggttgaacccgggaagcggaggttgcagtgagctgggatcaagccactgcactccagcctgggtgacagagtgagactcagtctccaaaaaaaaaacaccacaacatagatatttagatattttatatatttttaaaagaagcagatttgcttatataatgtgtttaaaactcagtctctgttttctaacagttacaacatcaacattatgcattagccaattttagaaggttcctgttttctaatgtagcaaaggggactaacagattaatgaactacaaatttacatttaaattggttattttcaagagtacctacaaactacagataaaatttgatgtctctctaatcaaactcttaagagtagtactcaagaaatggtggtatgcttggcaaataagatcatgaagcttttcatgttcttttttcttttttactggttattgatgacatatgaacattttagaaaatgtaaagaaaattataaacttgtaattttgtttcattcttttgaaatcttatgtataggttagtaaaactggagctgaaggtgctgtgctggatgaagctaaaaacatcaacaagtcactttctgctcttggaaatgttatttctgctttggctgagggtagtgtgagtatacatgtcttctatctccctgttaccttatggggcattatttaaatataggtgtatatgtgtgcctgggtgtgtatgagagagagagagagaaagagagattgagattcaatgtgtttgaatcagtatgtgtaagttagttgtcttttgggagtttattttataataacattttattatactggtcttgttttctttctttgtttttgtatgcagacatatgttccatatcgagatagtaaaatgacaagaatccttcaagattcattaggtggcaactgtagaaccactattgtaatttgctgctctccatcatcatacaatgagtctgaaacaaaatctacactcttatttggccaaaggtttgttgttaagaaagtacaaaacctaaatttagatagaccttttgtttataaaatgtaggaaaatgtgagctgttattccaacctgtacatactgttttgtgctagacacactcagtttgaattgatgacagataatacaaggtgggtctgatttttagactgcttggtttaagttttagtacacattaaagtcagatgtaattttagtcaaatttgtgtgacaagctgtaatttggtattaaagaaaataagcatttgaatcaaataatgaggtcaaagcctggcaaacataatcctctgttaagcctgtagacatgcatgacaggttaatataatctgtatgagatgattaggaaaatcagtaatgatgattccgtctttgactttcaacagtaatttcttaattcagccttgcaaacaaattggaaaaatataggcctttgtcttttatttttagtggtttgttgatttttttttttttaaagctattcacagattttggagcagactcaaatttagttgagttgtaaataacgtcatatgttgcggcttttagtatttagtctaagagattactggacaagcataagtttcttagccatatatacatatattccatatagataaaattaaaaataatttcagtctcatcctttttttcctccaattacatctcttagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggtaataacttaagaatttgtcatcttcagtttgttaaatacagatttagagcatagaaacgtagaaatagttcagcaaaatcagtaagtgactagatcaagaaatttaatagacatcgaaataatttttaaaaaaattaatagaaatcctggagctgaaaaataaaatgagcaaaatgcaagagaccatcagtagtagaattaattaagcagaagaatctgaacttgaagacagattatttgaaaataacacagagaagaaaaagtttgaaagaacgaggctgggtgcactggctcatgcctgtaatcctagcactttgggaggccaaggtgggcagatcacttgaggtcaggagttagagaccagcctggccaacatgttgaaaccccatctctactgaaaacaccaaaattagcctggcatggtgctgagcgcctgtaatcccagctaatcaggagtcttgaggcagtagaattgcttgaaccctggaggcagaggttgcagtgagcctagattgcaccactgcactccagccagggtgacagattgagactctgtctcaaaaaaaaaaaaaaaaatttttaaaggaatgaaattgaaattagctttagacgtcgtttttttattaaccactttattttcttattttaggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggtaggtattgcttgatttaggtctgctttatattaggatactattgacatgggtgtttttattttctaacttttctcatttcagtgctgtgggcacttaggatctttatgcatcttccttgatttctgttaatcttgtaaaaattattgtattaacaaaataaaaagtcataatttcaatttctgtgtggaaactgtatgagcatgtatcttttcttccccctctttttaagctaaaagaactttataaggcagcagtccccaacctttttggcaccagggactggtttcagggaagacagtttttccgtggatcaggtcggggagatggttttgggatgaaacttccaccttggattatcaggcattagattctcataaggatcctctaacctagatctcttgcatgcacagctgataatagagttcgcgctcttaatgatattctaatgctgctgatctggcagaaggcggagctcaagtggtaatgcttgctgctcacctcctgctgtgcttcttggttcctaacaggcttccagtactgctttgtggcctgggggcttggggacccctgttctaatgaaaatttggcattgggtcattgggagcctcaatgataccaattgttagaatcagggctctgaagactccaataaaagatgatgtgagagattaagggaaacacaatagagtggaaataatatcttcctgctttgcatatagaagtaatgtcaatagtatgaataatagcaaactaagaacgtaatagaatggaaggcaagaacaagagtagtaaagagattagaagaaaatattttcttaagttgatatttttaatatattttaagcagagatggcaggttcgaagtacatgaccattataagtattgataattgaaagaaattccttttgttttgccattttcttaaaagagattaaaataagcaatgttgaatttagagaaatggttttgaaatatttctggggagtagtaatcttataacctgtattgggaaacaactagaaccaggttgttagctactggttaaccggatacttcacaattctaggatgaagaaattaaccagcaaagtcaactggtagagaaactgaagacgcaaatgttggatcaggaggaggtgagttgaataccttttacattgcttccagaaaagctttatagttttgttttctgaatcccattgactttgtctttaatagttgtataattttgggtatgactgtctttgtgggaataagaatgtcacatggataaagtgaatttttacttattcatcgtatctacccagatacaatctgttgttcatttccgccatcttttttttcaccctggttcttgacatttctcttcttgtcacttactttggatcctcattttatcttctcacccagcagagcagggggataattgaaaagcagtcctttaaatttttttgtgggggtggtgggcagggtgaagacaaagactgcttcggtaagaaagagatactctccatcagtgaacttaatcctggtcagatcatctttcaactatagcatttcatatttcaactatagcattattcctcaaaggggcactattgatattttgcattggataatttatgttattctgtcctttgtattataggacattaaacattcctggtccctactcctaaatgccattagcattctaccctattattaacactcccacagatttccggatatccctacaggagagccactaatgtggatgattgtggttttctcctaactagtctcttggcatccctgcagttcagattttatgtgctgataccaggttttgtttttgtttttgaggcgaagtcttgctcttgttccccaggctggagtgcagcggcgtgatcttggctcactgcaacctccacctcccaggttcaagcgactcttctgcctcagcctcccgagtagctgggattacaggcgcccgccaccacgcctggctaattttttggtatttttagtagagacgggatttcaccatgttggtcaggctggtctcaaactcctgaccttgtgatccgcccgcctcggcctcccaaaatgctgggattacaggcgtgagccaccccgcctggcccaaatctaaatttttaagcaactcttgtagaatgccattttcctttattacattaatttgcatgtgactgcagtcgatctctcctagccaacttctccatgaatgaatactctttcctgtattactaagcactttatctgtcctgtccctctcttatggttctgaccttctatcttgtactgcacttattcatgtgcctatcttctcttctactgtgttccttaaacacagtctttgattttctttctgccttgcagcatccagcacagtgcctgcacatagttgacatttagtaaatctgtttaatgaataaatgttgccacactgaataccatccatatttcactccatttgttcttgacaaatggtgaagcttcatgggtgttttttaaaacctgtatacttttggggaaaataaattattttctgtcctatagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggtaggatatagttttattttcttttttaatgctttagtacaagtattcttaacctaaaaactacttaaataacttacttttctatgtaagtcaaatatcgataacatcaattttcaaggactcgggtttcaacttcatttctttctgtatatgaagccttagaggtggaggaagacagttattttagttcctaaaggtctgttaatatctaatttaaatgctgttttagaggatgtttgctactcctaattttaatttttttaatttagtatatagcatgtagaatctaatgttactactaatgttaaaggaaaaataatttaaagctgctagttgcccaataaagctattagatgattgttcaaacaataaattaaatatgcagtacaaattaaaatgctatttaatcaactgtgaattatttggaatagatgtaaggatatgtaacttaacataatttatgttttacttactgttacatttccactacgtggaacagtgcctttttagcacagtgtagtggttcccaatagatggagatttttttttttttttttgagacaaagtttcactctggttgcccaggctggagtgcaatggcgcaatcttggctcactgcatcctctgcctcctgggttcaatgattctcctgcctcagtctcccgagtagctgggattacaggcgcccgccaccacgcccggctcattttgtatttttagtagcaacagggtttcaccatgttggccaggctggtctcgagctcctgacctcaggtgatccacccacctcagcctcccaaagtgctgggattacaggcgtgagccaccgtgcctggcgactagatggagatttttacttgctgaaaattgatacaggacagacatcgccaacctccaacaatgatgacagaaataatacatagctatgaatgtttcaacatcatcatggaggagctattttgtggttttgttgtggttaatgctagcttcttgtttagaaatcagcatctagagttgcactcaggacccatgtccaccacttatttccctgctcacattaacttgtctaaaagaaagcagtcaacagtacaaaataatgcttttaaaaggtttcctgcccctatgagttccttttctctttttaatctacaaagttacagttagcttgaagttaacattcagtactgtacagatctaagacaccattataactaactcttactgagttgcattattaacaaagctaattgttgtatgaaagaataacaggagttttttacaactctgaaaggtggtccttggccgctgattttagtctttaagacagttatatttatgtttcacttgtggagctgaaatctatcagcattacattgataataggagttagaaatccctagtgtttagcatctgtttatatgcttagacagtgttgctgttcagttagagagtgtctggtaatttaaacaattatggtagaagcatgctatattatgagacttgaagataattggtatcatattgtagattaacctgggtggatacatactctactgatactcagaaacttaaggaaatgacgaactaccataagaaataagcagttggaatgatggcatctttactaaaagatactgatgaaaagtcaataaatggcattacaaatacagtatagtacaggcattacaaatacagaagccccaagcgtttcagattttggaatgtttgcattatacttaccagttgagcatttctaattggcaagtccaaaatgcttcagtgagcattttctttgagcatcatgcaagcactcaaaaagtcccagattttcgagcacttcggagtggggatgctcaccttgtatctgttctgccatatgagttattttaaagtgggcaccaaactgggttggacttttcaaaatttggtgattttgtagctgttaagccagctatgatttgagatttataatgatagtcattaaactcagataatattactttaacactagctcctggataattgcctgtatcatagtattatcacatggattctttccagtgagtaagtatatagaaagtagatgaagaaagcatactaaccatctagaaaagagtgtcattgtaacgttaatttgctgactcactttctaaagataagacataatatagtaataagtgataatcaaatctagttaaatttgaggcttcccatttttagacagaaaatattattcaatcccaggaatttagtgaaataacagaaactgcctgctcttaattgaaaacaatgtggctacttttaccatagcctattaggtctaaaatatattttaagtttgagctgggagcccagaacctggtagatagttcaagaaaaatgaaagcagaaaagacatggtttcgtaagggcttggtgtaaaacttgaaacaccgatgagtatttgatttgaattttcatgtagtagatttaactatactttttgttttgggttctcttaggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaaggtaaatataataactaagtattaaggacaattatctgtatacactggcacttttgtttactactaatagtttgtaaagttcttttcgtattcatgatctcatcctcacaaacagtcgtgtagtagatgttattaaccgcattttaaatagatcaggagagagcaagagaataagggcacccaaataggtaaattcagtaggcggcatttattggacctcatgtttgattctttactataacattttccccaacctgggcaatgtggcgaaaccctgtctctacaaaaaatacaaaaatgagcctggcatggtggcgtgtgcctgtagtcccagctactggggtgggaggattgcttgagcctgggaggtcaaggctgcagtgagctgcaatcgtgcaactgcactccagcctgcacaacagatcaagatgctgtctccagaaaaaaaaaaaattcgtgcttaaaaattacgttaataaatttccataagtgaaatgattggaacaacaattaagattagttcacggaccagacatagtggctcaagcctgtaatcccagcactttgggaggccaaggcaggaggatcacttgagcccaggagttcgagaccagcctgggcaacgtggcaagaccttgtccctacaaaaaatttaaaaattagcctagcatgtaggcatggtgatacatgcctgtagtcccagctattttaagagactgaggcaggaggttaaagatgctgtgaaccatgtttgtgccatggcactccagcctgagcaacagtgagaccctatctggaaaaaaaaaaaaaaaaaagattagctcagggaataaatttataatgaatgggcttgtggttgctttaaatatttaaagaaaagttaaagatgagcactgctttcttaattcttttttattttagtgtgaaaaatttcaaacatataatagtagagagaataatacaatgaactctagagttttcagttttcaaaatatgtccatattttctttatacctctttgtcctaatctttttaaagatactaatattggttgttagcattaggcatttgacttggtggtagatttaaaaactaagaccaaagaaccaaactaagactcttaactgaaaaaccatgcatataacatgaaagatttgtatgttgcagtagctgtttagactttacctttttgattaaagcctaattacaatacaaagagagcatatacacttgggtttatattgagagcctactaaaaagcccagtctgttaaccagagttggaactgacgtaaaagttttcaatatggagtacacatttccatcttttgtattgtttaatgttgctgtttgctgttaactgattcttcagtttaaaaatgaagaaaaaatatttttaaaaaatacaaaaagaataaaagataaaatcaacaaaataaaagttactgtttgttgatggaggcaaggattctcatgactcttctcttcatatgttatttcttcagtggactcactatggggccacttgacttgctttcccttcaccatcagtctgaacatttcggccctattctgtttatggtgaagtaatgtgagatgtagagaaatctctaggatggaaaagtacatttatttcatatcgcagaacaccagagagatgttgttcaagatttgctttgtagatttgcaactttttagacaaatcttatattttatgttcaaataattatgatttaagttaaaaagtgtaaagagagagtggaaatggtttatgtttagtggcagagggatgaaatccaggttccatgactactagatttttttttccactataccatagcagtttgaaaataagtcgtctttgcaaatagttattctaattaaaaaaaaaaaaggatcctcagtatttttgtcattaacaagtaattcttttcctctcatcatatataagctctgttagagcgttacttttttttttttttttttttttttgagacggaatctcactgtgtctcccaggctggagtgcagtagtgcgatcttggctcactgcaagctccgcctcccgggttcatgccattctcccacctcggcctcccgagtagctaggattacaggcgtgtgccaccacgcctggataattttgtttttgtatttttagtagagatggagtttcaccgtgttagccaggatggtcttgatctcctgacctctttatctgcccacctcggcctcccagagtgctgggattacaggcatgagccactgcgcccggcctgttgttgttcttaagttacagtttacagttttatgttacagtttacaatgattgttgtactcattgtattctatagttgtgtggattttaaggagtgcataatattataggtccggtatttagaatagttcccacaccaccctaacaaattcccagtgtttttgctattcacctctacttcttgaacttctggcaaccactgatgtttttactatctttatagtattgctgtttccaaaatgttatatagttggaatcatacagtatgtatatgtagccctttcagctagtttctttcacttaccagtatgcatttaagattcttccatggcttttcatggcttgatcatttttttaaattactaaattatattccatgatatgaatgtaccatggtttgtttatccattcacctatgtggttactttgaggttttggcaattaatgaacaaagctgctataaacattcatgtgtaggctgagcatggtggctcatgcctgtaatcccagcacttcgggaggccgaggcgggcagatcacttgaggctaggagtttgagaccagcctggccaaagtggtgaagtcccatctctacaaaaaataaaaaaactagccaggcatagtggtgcacgcctatagtcccagctatttgggaggctaaggcacgagaattgcttgagcccaggaagtggaggttgcagtgagccaagatggtaccactgcactccttcctaggtgacagagtgagactctgtctccaaaaaaaataataataattcatgtgtaagttattctttggacataaattttcagttcagttgagtaaaaatacctagaagtgctaggttgtacgttatgactatgttagctttgtaaggaactcccaaatggtcttccaaagtggtggaaacattttgcattcctatcagccatgaatgagagtctgctgttccacatcattgccagtgtttgctcttgtcagtttcttgggattttactaatgtatggtgttattttattgtcattttaatttgcagttgtgttttttcttattgttgaggttttctttttctttgagacggagtctcgctctgtcacccaggctggagtgcagtggcgtgattttggcccaccataacctccgcctcctgggttcaagtgattcttctgcctcagcctgccaaatagctgggaacacaggcgcgtaccaccacgcctggttaatttttatatttttagtagagatgggatttcaccatattgtccaggctggtttcgaactcctgactacaggtggtccgcctgcctcagcctcccaaagtgctggtactacaggcatgagccactgcgcctggccctgttgttgagttttgttttgttttattttgagatggagtctcgctctgtcgcctaggttggagtgcagtggcatgatctcggctcactgcaagctcctcttcctgggttcaagcaattcttctgcctcagcctcccgagtagctgggactacaggctcccactaccacacctggctaattttttgtatttttagtagcaactgggtttcgccatattggccaggctggtcttgaactcctgacctcaggtgatctgcccgcgtcagcctcccaaattgctgggattacaggcgtgagccaccgtacctggcctcctattgttgagttttaagagttcttcggccgggcgcggtggctcacgcctgtaatcccagcactttgggaggccgaggcgggcggatcacgaggtcaggagatcaagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagagttcttcatatgttttggatataagtcttttatcagatagtgttttgcattatttctctgtgtcttgtttttttttttttgttttttttttttactctcaacgtcattttttgagactaaaaatttttaattttaatgaggtccaacttaccaagttttacattaatagattgtgtttttggtattgtatttaaaaacttgtcaccaaacccaatatcacctagattttctcctgtgttaaaagtttttttttcagttttgcatttacatttagatctatgatccatttggagttaatttttctgaaaggggtaaggtgtgtaccaggattcattgtttcacatctggatgtccagttgaagagactgtcctccctccattaaattgcctttgcacctttgtcagagatcagttgactgtattttgtggttttattcctgggctctttattctgttctgttaacctgtttatctgttctttgccagcactgtactgttttgattattatagctttacagtaagttgcatagtgtcaagtcctgtgactttgtttgtccttagtgttgtgctagctattcagggtcttttgactttacatgtaaacttaatcatgtcatctgcacagttttatttcttcctgaaggtgaaggaatatacagtgaccacaattccttctggttgagcttaaagttcatcctttccctgccacctaaacatcctcttgttaaattttaagctgaacgtgcacatgattaacaatgaatttactgaagaggtcctgtaaagaggaagtgaaaaaattgaaagaggcagaatttattagtttggttgtatttttgtgttttctttaggtttacatttatttatttttcttgttggcatgtattaacattattctcagtttttaaaaaaaggaaggcaaaaagtaagctgtatttatttacctttcgttgaaaacagtaataaaagaaaaaaataagatccagactttgtatgaatattgagtaatactaaaatatattttataaaaagattttatagcctaattgggaaaacacacattgaacatttttggctttaattttttattttactttttccttacagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaagtatgttatagaacaaagtttattcatttttttgaaacagccacatagaaattttatttattatacaagttttcagaaaaatgtgtgtctataggtgaaatttagttgtttttttcctagtctagctgcagtaaatttgaatgatttaactgagttatatttgcctaacataaatatgggttatgtatagaaatttaccagaatgatgtgactggtggtaacttgttaaagacttcagaattccagggtgggcaaaactgcagggaaccagtttcctggcttggcaactgaatgaatggggccattcaccactatcagaatttcacaaggagggaagatggtaacgttagatggtggtatctgtaaaattagtatttcatatttgagtcttcagtgccttagtttgcaagttatgatcaccaatgaattaattgattacattctttaacatttcaaaattggctcctgaatattttagttttaaatattcccaaatttatcatatatagataatgaaatgtttactgtcaaatattcttaaagtgtatgcatatgttttccacttcatatcagtatattttttccaaaagcatgaagccaaaatcaagtcattgactgaataccttcaaaatgtggaacaaaagaaaagacagttggaggaatctgtcgatgccctcagtgaagaactagtccagcttcgagcacaaggtatagcttccaactgtttatgagttacatctgtgttcttattttagtataattgtagtaaacttaatattcacactgaaagaaatagtaggaatatggctgatttcgaatggtaaacaaatcatacatattaatgttgctttgaaacatttttttgttgttgttttgagacggcgtcttcactctgttgcccaggctggagtgcagtggcactatcttgactcactgcaacctccacctcctgggttccagtgattctcctgctgcagcctccctagtagctaggaccacaggcacatgcccccacgcctggctaattttttaccttttttgtagagacagggcttcaccgtgttacgcaggatggtcttgatctcctgacctcgtgatctgcctgccttggcctcccaaagtgctgggattacaggcatgagccactgtgcctgtcaaaacatatatatatatatttttaagattttgtttgaatatggaaatagccaatctggggatttcccacagttacgaagcggggtgtgtgtgtgtgtgtgtcttaacataggggacttaggagttatctcatttctttaccattcccttaactaatctgttctggattaggccaaaaaaaaaaaaaccaaacaaaccataaaggaatacataataccaacacaatggatgtaacttgtatactagtctacatgtcattgaacttggagagcaggtgacatttgggtaatttgaagttgaatattgctaaggaaaatgcttattgtaaaatccatttgctccttggtttatatgaggaaccttaaaggcttatttcactcttctattttctctctattcaaacagagaaagtccatgaaatggaaaaggagcacttaaataaggttcagactgcaaatgaagttaaggcaagtttgatgtcacatttctaacagctttaattaatcagtattaattttgattagtctgactttaacatccttttcccccccaaaattttagcaagctgttgaacagcagatccagagccatagagaaactcatcaaaaacagatcagtagtttgagagatgaagtagaagcaaaagcaaaacttattactgatcttcaagagtaagtattatacttctctagttaggaggaaagaatcggttactgatggtcatggtatatattcttattagaaacctgcagttttcatcaaaattacatttttatcttggaaaataaagaattttctcatttatgagtaaaacttctaaattccaggtgaaatttttgaggcttttttttaggtcttttgatctaaattattcagtaaaagaaaaaaatccccaacctaagtctattattgcataccacagtcttctccaaatcctttatttagtttccttttttaaaaaaattcttggctgggtgcagtggctgatggcctgtgaccccagtgctttgggaggctggggtgggaggatcactagaagtcaggagttcaagaccagctgggcaacatagtgagactccatctctacaaaaaataattttttaaattagctgagcttggtggcacatgcctgtagtcccagtgacccaggaggctgtggcacgaggattgcttgagtattggaatctgaggctgaagtgagctatgattgtactacagcctgggtgacagagcgagaccctgactcaaaattcttaactgggaaaaacttttctggaaattctatggattttcaaaggtttttttttttttaagttgtcatcttagtttatctagaagcaatttccctgcctccataaccatgtgcacatacatagagtttatggaagtcagagtttgcaacaatttgagtaggaaccaagaagagaataacataacaaaataatgatgaggtttggggcgtaggtcttactatgaatacctgatggaagtaggcataaggattcaggaagatgaaagacagaggagaacagaatcatgatttcaaaccaaaatacgaaaaattttgtatgtccacaagtagccaggtccctttcctcttttcctccatagggtataggataacagaaaagtccttgatgagattatagaatttaaaagtttggaaattttaatgatgacattgagaaaactgtgatattgatactgtgttaattatttttttctttcgtcagccaaaaccagaaaatgatgttagagcaggaacgtctaagagtagaacatgagaagttgaaagccacagatcaggaaaagagcagaaaactacatgaacttacgtgagtaattgtttttaattaaagtttaaaaataaaagctaaattagaggattataggcattacctttggatatagccagtggatacatattttactttgtatgggctaaaggattttttcttaaatccactgagttggtttgatttatatctaaatacttggaatatatacttgcatttgagtgaaagcaaggtcttatatttcattgtggttaagattaaggtttctctttattaatctgcttgctgtttctttatctccatattacttcaggatccagcataaaaatgaacctaaaacaatatattaagtaacttcgaagattttaagatctaacacaaaaactgagtttttgttaaattttctcttgcataaaagagcattgtggtgtttagccttgccattttgaacagaggttttcatggtttaccttttctcattttctcaaaactcagttttctagaatcttagcaggtagaaagtgcatgattataatttttcacataccttgagtttgtgagacaatttgcaaatcaactgatattgttaggatagttagaacatcaggaccagttcagagtggattatatgaagattctgctaacttgcagctgtaattttgtttagaatacttgtaatgtaaaatattttagtctttgacagtttataatctataattaatcagtatcattttggataaatagcagtataatacatgtggcatattttaaaatataaattatagaactattccttattctttgaattctgccacattttatttcatctcttccattgctatatatggaatgtataacaatagactgttgtttagaaggcatatgaaaattttttgaaattgcaaagctgcagtggctcacacccataatctcagcactttgggaggccagggcaggagaatcagttgagcccagtgtttgagaatcagcctaggcaatatagtgagaccccgtctctacaaaaatttttttagacagggctgattgtacatgcctgtagtcccagctatttgggagacgaggtgaggaggatcacttgagcccaggaggttgaggttgcagtgagcagtgtttgggacagaaactctgtgtcaaaaaaaaaaaaattttttttttgaaagacagcacaggtaaattgtttaaaataggcatcttgtatttatttaaatttaagaatttatcctttcagacacaaaatattttattcaactctcatgctaagtacaatatacagaataaaatttgaaaatatatgtttgttcttctactgttagggttatgcaagatagacgagaacaagcaagacaagacttgaagggtttggaagagacagtggtaagaaaaacatgaaaataaacaggattgggaaatattttgtgggttttttctaccatgattattctaaatttaaagtctgagctccaaaaatatcgctgttcttaatccaaggcaaaagaacttcagactttacacaacctgcgcaaactctttgttcaggacctggctacaagagttaaaaaggtaatgtaactatgccgaggtaggcgtttgcataaatggtgcttacttctaggtaattatttgtattcaaagtgaaataactttacagtcacgtcaatttttgtatagttaagcttagttttttttaatttttttgtaatacttaccttcttttctcagagtgctgagattgattctgatgacaccggaggcagcgctgctcagaagcaaaaaatctcctttcttgaaaataatcttgaacagctcactaaagtgcacaaacaggtactaaagagtatattttctggtagctgcaagatagtaaaaatcaaaaattgaggattggcaagtgagtatttcaatctttcagagtcctcaggaatttttataccctgagccattttatcagaaattatataaagaaaccataagtaacttttagaggagttaatatttttaacaacgttattatcaaaagaggcagtgaaaacatgtattctcattttccctttaggattttaagactgtgcattttcataatttattcatggtaattttgaaatctctactacacaagactgcagttaaagtactgcaaagtcttttggggagagtggtctttttatacctaataccccagtgtgtcagacataatgacgcagttttcatttaaccagattagttgtcttactgaagaaacatagcactatcttgtaatgtattgtctttgcctagtagagggaaagaacaattctccccctaaaaaattaaaggaaattatacctttgtgaataaactagatgtgtgcacgctatgtatagatggatgtattccttgcgtgtttctgcctaaattagataaatgggaaacaatataaaatgcagttttacttttctaaagagcaattatgaaatgctcatactttttcaagtcatcctgttaaatctggaatccttgttttctttgtgtacgtttagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattggttagtagaacacattaaaacctttaaaccttgctcaatttgaatgctttcatttagtggaaaacgtaatccgaattttatgtgttgtcatggtgcatctgtctctattttctaacttagcagagtggcactgttgggaaagaggaataatcacattagcagaaaaagaagataaatgagaactagagaagcaagcaagaatggtcatggaatggagaaactatatagagcaatattattaaagccaagagaattgcaagaaaataagccatcagcaatgatttaacgtttaagaataatcattggtggctgggcgcagcggctcacgcctgtaatcccaacactttgggaggtcgaggcgggtggatcacctgaggtcagaagttcgagaccagcctaacatggtgaaaccctgtctctactaaataaaaaaaattagccaggcatggtggtgaacgcctgtaacccagcaacttgggaggctgaggcaggagaatcgctggaacctgggaagtggagattgcaatgagccgagattgcaatgagccaagattgcaccattgcactccggcctgggtgacgagcgagactccatctcaaaaaacaaacaaacaaacaaacaaaaattggtgcaggaagtgttttttttgtgttttatttatttatttattttttgcttgttttttgagatggagtttcactcttgttgcacaggctggagtgcaatggcgtgatctcggctcactgcaacctctgcctcctgggttcaagcgattctcctgcctcagcctccctagtagctgggattgaaggtgcaagccaccatgcccagctaattttgtatttttagtagagacagggtttctccttgttggtcaggctggtctcgtactcctgacctcagatgatccacctgcctcggcctcccaaagtgctgggattacaggcatgagccactgcccagccattttttttgtttgtttgtttgcttgttttttatgacacagggtcttgcttgtcacccatgctagactgcagtggtgcaattatggctcactgcagccccagcctcccagggtcatgcaatcctcccacctcagccttccaagtagctgggactacaggtgcacgccaccacacctagctaatttttttatattctgtagagacagggttttgccttattgcctagtctggtcttgaattcctggacccaaatgatccacccacctcaggctctcaaagtgctgggattacacaggtatgagccactacgcctggccaggaagatttttaaaggctaagaattgtataggtcctagagaaaaggatgttacagaaaagaaaaagtgatggagaaacaaaaaggcaaagaaaaacaaaacatttgggaatttgttgtgaataagagaagaaaccttaacagtcattgcagtcacatcttaaactttattctaaagtctgtctttatttttcatattagctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtttgttatttatatctggcttttcatatctgtttgtggaaaattggttgttaaataggttttttggttttaaaaaattctcacattagtgttatgatttttttaacttaagcattataaaagtaatttagtttgatctttttgtgtagtttagatcatactatatattcaaatttgtggtcttaattgttttgaaatctagcattggaccatttgtaatagcttttgatactgtgtctaatggatgtaccatggtttataaacattcctttccttttggctagacatgtaattatattaattttttccataattgaaattttcaaaaaccaaaattttcatatatgaaatttgaaacatctttttttttttttctttttctttttgagatggaatctcactcttgtcgcccagcctggagtgcaatggcgtgatctcagctcactgcaacctctggctcctgggttcaagcgatacccctgcctcagcctcccaaactgggattacaggcgcctgccaccatgcctggctaatttttgtgtttttagtagagacgaggggtttcaccatgttggtcaggctggtctcaaactcctgacttcaggcgatctgcccgcctcggcctcccaaagtgctggaattagaggcgtgagccaccgcgcccgacctgaaacatctccttgtattccctaacctgttagagattatttccagaaggttcccagaaatgcaattacaaggaaatatgaacatttttaaggctcttgctacatattaacacattggtttctagaaagactgcaccaaattgcttatgagcccagcttactaacagatttctgagttttatttataattatataagtaatatctgttctttgtagggcataaaacagtcacaaattagaaaaaatctagagatactacacaatatactatctctctctctctctctctctttctggagctttctgtattagtttttaaatttaaaagtttaaactgttgataactattgtaatagactccacttattctactacatatgctgcttcggagcctgcttttttttccggccccctgcccccacaaaccccacacccccctgccccactccgagacggagcctcgttcttgttgcccaggctgacatgcagtggggtgatcttggctcaccgcaacctctgcttcccaggttgaagcgattctcctgcctcagcctcccaagtagctgggattacaggcgtgcaccaccacaccggctaattttgtattttgtagcctgctttttaaacttagcaatatattcggaacactttcttctacaacgtgattggttagtggttgcctaataattggtcatatagcagcaactctgattgtaactaactcttcaggaagtccctgatgtgtgtatgtgctttggaaataaaaaatactagataattatgaaatgatcagctgtttctgacaaatactaaagctagtttattttaatgttgcttgtttatacttcgacattttgcataatactggctctaagttgagtagagaattaagaaatattctgaaggattcacatttctagcaattttaaacgttttgttcacacaatgtaggatttaaaacagtggtagagtgaaaagaacagggactatggagttccatccaagttggaatcctgactacttttatgaacttgagcagataaactttttaatagtttttttctcattctgacttgttttacagtacttcataaaaattatggatttattgcttaactatttaatgaatctctaaaataacatttttctacatagccacaatattatcacacccagtaagattatatttttaatattatttaataccattccatattcagatttttccaatttctttttcactatcctgtacagctggtttgtctaaaccagagtacaattcaggactgctgtttgcgtttagttttatcccttaaatctcttctgatcttgaatgagcaccctctttagtgatattgacttactgagtaggcccagttatcttgagggtataacacctgtgtctgattgtttttatgtgtagtcaccttgttctccctctatttctatgcaaaagcattgattagactcagcataaacatttttgacaaagttatgtcatagataatatgtacttaatatcagtagacatacaatagctggttttcatgataattagagataactcctgtgtttttcccctttggactcatagcagttttattagtaaaatggaagtcattcttaagaattacatgagttggccgggagcagtggctcacacctgtaatcccagcacttgggaggctgaggtgggtgggtcacctcaggtcaggagttcgagaccagcctgaccaacacggagaaaccctgcctctactaaaaatacaaaatcagcagggcgtggtggcacatgcctgtaatcccagctactcgggaggctggggcaggagaatcgcttgaacccaggaggcggagtttgcagtgatccgagatcgtggcattgcactccagcctgggcaacaagagcaaaactccgtctcaaaaaaaaaaaaaaaaaaattacatgagttaagatgttacccagcacacagtattcagtagatgcaagccttttcctacctttctggaagtgggagctgggcaaggggattttcaaagcatagatagaaagtttatcctttttggatattgtcctcacattaaaattcatatgtcaactttaaacttacctcattgtagagagaggacagaccatacttttgttaactattgctgatagcagtaaagtgacaccaggttagcacataagggagggagctaacccagccaaactaggttttcaagacttgaaagttatgatgtaaaaatacaattatttacaggtttgttttgatgctggtccaaagatagtggttcttagttttcaaactcttataatctatcttaaaccatgattggggagtatatgattcacttaagtgataaattgtttaaatgttaaataatttgcactggagtgcagtggcaggatctcggctcactgcaacctctgcttcccgggttcaagcagttctccctgcctcaccctcccgagtagctgggattacaggcgcccactaccacgcccgcctaaggtttttgtatttttactagagacggggttttgccatgttggccaggctggtattgaactcctgaccgcaggtgatctgcctccctcagcctcccaaagtgctcagattacaggtgtgagccactgtgcccggcgagaaatttttttaatgttaagaaaaacatttcaagtcactgtgtttatttttggaaaggatgacatttataatactgatacttttagttcccagttttacatgactagtcttctgccttgcatagtactttaaataggttgcttttctaaatgcataggtaagtaggcagtttaatactactagaattatttatttcactgttacttttcctactgtatacacctcttgtttatccctattcctctcccccttttttttttaaagcttctatgtatataactagtagttgctggttagtgttccttggtttaagaaggtcactgaccactgtctgctggttaaaagattagccgtctttttcttttttaaacaaatacaattcataaatcagcttacccatagctttatttgggagaataaaaacaaagggagggctgacctccctttaaacattactgcttctaaacagttctacttaggtagtatataaaaggaaaccaaatcatttaatattgccatccttctaattttggggaaagtagccacagatgttggctaaaatgtttataataaactgttggcatattttattttgttttattcttcatgattatctcaaacaccaattttgtaaaactaaacatatttactctatgctttctcccatttttaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaatgtaa

SEQ ID NO: 3 - DNA, 39678 bp, Homo sapiens
  misc_feature: TFG
tggtcacgccccgcgcatgcgtgcatcggggcagctcacgcttcctaaatcccgtcatccagtgagaaagcagggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccggtatggccactggagacgggggttgcgggcgctctgtccgaggaggccgggagactaggaggcgctgggagggcctcgttcgaaccgcgcggcagctggggtcggaggcactgtgggaaggggctggagggaggagggggtgggagggaggagggggtgggagggaggacgaggccgggggggagggcgggcggggccttgcatggggggaggggaagggaggtcgcggagggggaggggagagaggcaacccctggctgcggtggccaggaggcgcgcctggggggctccgggaggggagtgcgccagctaatgccttggtgcagcctgcctccaagcgtttggattgagaggagaggggctttgggaggtttggggcggccggcgcccaatacccgaaggagctcggaagggtgtggagtggcgcctacgggaataagttgattggggtcatagaatcggagcctagttccttggctaagtcagcgcttaatcaagcgccggctggaggcccagcctggtttatagtgatgattctagctaactttaagagtttgctttgctggacactacagtaagtattttggatgcactgtctcatttaatcatcacaaggattcctccaaattcagatatggttgttttcatttcgaatgtgatgaaagtgagccttggaggacttaagatcacatagctagtagtgagaatctttaccgtcttgctgcactgcctttgaggcagggtttgaggcctcttggcattctttagaataattacaggttgacttggcttagtatttcttgaaggaaactgctcccctcaggaggtgcttaagccacagcctctgaaattgagcagggtcttacccttagaggtagtagaaccagaagtttgtccgccgaacctagaacctggttcaggaggcaggctttttatatgaccttgggcgtgtcagattattcccagtgctgagaaaagtgtacctggtagagggttatattatacaagttagaagccgagtcatttctggacttcagagggggcggggcaaggacaagatgggagaagagcttgtcgtagggctcctactggcagttctaggaactagttaataccagtctctactttggaagagaaaatgagtaccagaattctgtatgtgaagtaatgttgggttgggatttccccttgaagggaaagttttgttgcacacttacttttgagatacttttgtgtttactctggggagatgactgcaagagcaaacgacagctttaggaaagaagcactggttcctggccacaagatgtttacagtcaataggaaacacaaaaagtgaatttgcaggtaaacacggcagatagaaagtatacgtgactcaatttttttttttttttgagacggagtctggctctgtcgcccaggctgtagtgcagtggcgtgatcccccagctcactgcaacctccgcctcccgggttcaagcgattctcctgcctcagtctcctgagtatctgggattacaggcgtgcgccacgacaactggctcatttttgtatttttagtagagacagggtttcaccctgttgatcggtctggtcttggactcctgacctcgtgatctgcccgcctcggcctcccaaagtgctgggattacaggtgtgagccaccgtgcccggccctcaaattttaaatccattgaaattgggcaacaaacccgtaccccagtcagaaggacataccatcaattatcttcaaagctggaatttttttcttaattaggagtgtgtctgatggaagtcacttctagctacataaagaaggtacagtgtgaggggtcggatgtaaaaactgatctatattacagctttcttctcccataattaaaaaatttaaacaaagtctttaaattctatatgtcaggcacttttctaggtgctgctgggaatagatagtaccagctcactgaagctaagcactggttccttttacattattgctggtttacacttcttgtaggaaggagaaggtaacaaatacattgatttattgaaaggtctttattactcttaggctgccagagcaagcaagatggaatatttaccatcttggtgaagtaattatactttagagttggcacatagtaggtatttaataagtagttcctgaataccgaaagcattgcagaaggcattgcagaaggcgaagagttggttgtgtggagatttctgttaatcactgtcttcacgagaagtccattgtgagaactggcagataaaaagctaactgtattcttattttgcattaagataagcatggcatccctagagtggaatgcagttcactctgttctgcattgaccttagagtgttatatttagttttaatgacccatttcattgaagatttattaataaaatatctgttgagagcatggtgaggggtctagagatattaatttaaggactagttagatggaaggacctagcgtatttatatgaagaatagtagggcattaatatataatattcatataataggattcatgaaaacttttttgaagtacttgaagggttgatatgttgggggagtaggtgagtgctttcacataccccgaaagaataaagaataattgcagagaagtgtggtgttaatgaaataacagatttaagaggaggaagcagaaagctgctagtagtaaggcgggaagttgaaactagaatgtggccagtagtagtttgtaggataccttgaaaagtctcaagagatcattttcttggggcaggaggaggaaggagttatgcttggaaaatgttcagcgattatagataacattcaggaacatcttggccttgagaagaagagatattaatccattatttttccctttatttaatagctgttgaatgactgttgtctgctaggcactgttgtagactctgggaatatggaaaacataatcgtttacttcctaccatcaagtggaaaagacaataaaatgttataaatttttaatgtctggtagtgttaagtgctttgaagaaaaataaagcaggataagaagataatgccaggggagccattttaaattagatggttaggaaagatctctctcagttaacacttgataaggaatctgaatcatatgaggggtatcagaaagggtcaagacaaagggaaaacttgaagtatgggaatagcaggggtgagtgaagaagagaggtaggaaatgaagttaaatacttggccagggactggaggccagatgattttataggtcttgctttttgggatgagaatgcattggaaggttttgaacagaatgatactaggttttacttaacagtgttaactctggtgttctgagactagattaaaagtgggcaaaggtaaaaagcaggcagactggttaggagtcttttccagtcatttaggcaagtgatgatggtggcttgaatcaagttgatagcagtgaaggtgctgaagtggttggaccccagagttattttaaaggcagtggcaaccatattttcttggcagtttggatgtaaggtttgagagagagagatcaaccaagatttttttgtcttatacaactcgaaggaagataaagaagcctctaggagaggcaggttttaggtggaagatcaggaatttatttttagatatattaagaaaaatctaaatggtcatgtcagatgaacagttaaatatgagaaaaaataatagtagacgtaaaataaaagcttattttattatccctacagtaaaataatgttgcctccagaccattttaacataaatatggtaacatggggataatgaatcttttggaggctagagtttcttagcatctaatagtagctttgctctcaacttttacggtatgttttgttgtttaattatcaaaaccacttttatcagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaaggtaagagtgtttttaaagctattttttaaagtctttttaaaaaaaaaaaaaaaaagacagagcctctgttgcccaggctggagtacagtggtgtgatcatagctcagtgtcacctcaaactcctgggctcaagcaatcctgcctcggcctcccaaagtgctgggattacaggcatgaactgccatgcctgaccttaaagtcttaagtattgtatgtgttattttgcccatttttattggactctttcccatcctctcttcacggtagttgagacctcactttcttgtattgaatgtgatgttcctatagttactataattctctcatcagttaaaattagctaagtggggccgggcgcagcagctcatgcctgtaatcccagcactttgggagaccgaggtaggcggatcatttgaggtcaggagttcaagatcagcctggccaacatggcgaaaccctgtctctactaaaaataccaaaaattagctgggcgtggtggtgtgcgcctgtaatcccaactactcgggaggatgaggcagagaattacttgaacccgggaggtggagcttacattgagccaagatcgtgccactgcactccagcctgggtgacacagcaagactccgtctcaaaaaaaaaaaaatagctaattggtttattagaagggaattttaagtgttagaacattttcacatacattttttttacaagcattattttctccttttgtccatataattctggtttcttttagcttaaaaaaattttttttctattcttatttcccgaaatgaaaggttttagtatgtattgaatgaaaaaggattttatggtcaactaagtaagggaaagctggtttaaacaaagacaaaagtgtttctttattgtaggagttttcagattatgtaatatgcttatatacattttcagaagttagtagtatgcagtgttcccagactcatttgttgacaaaattatctttatggaaataggttttgaatgaaaaatgtttcggcaaacacactgagtagaattatagtagtagactgtatttcctattcttcaacctgccttctttgttaatatctctgctgaaattttctctttaggtggttaccagtgttttttactgtggaacttacttgcagtgtatttaatcttgacctcactgtttagcactgctacccacaccatccttgtttttaaatacttttacctcttaacatctctgacactgcttaacctagttttcttatcactaacagttttttctctgtctgtgttagggttgggcttaaagtaatgccagcagatataatagaaatcttaaaatctgagtggtttaatagttgagaaatctttcagggatccaggttgaaagaagctgttaccttcaacacatggcttataagctcaccataggcattgacattggcaagcagatgagtgaagacagagtatgaagaatcatatgggagattttactcactaggcctgatggtgttgtatgtcatttctgcccttatgacattggtcagtacccagttacatggctttgctaagatgcaaatgggttgggaagtatagtccctggctgagcagccacttagcacaacttatactgtggaggagaagtgtaaatcactggtgatcagttaaattgaccatctagctaaaggtataattctcctttgtttttgtgatgtgtagtctaagaatacccaaaacaaatttttgagagttgcccatgttaagaaacaataaaggatagtacttttttcctgttttcttatgcttatcatacattgatttgcacctctgtgactttgaaatgtgtgtcttaatttgatcagtgaattttttttttttttgagacagggtctcactctcatccaggctacagtgcagtggcatgattatagctcatcataacctttaactcctgtccccaggcaatactgccaacccggcctcccaaaggcataagccaccatgcccagcctacaattcagatttttaacttttttttttttttagcaaagtcccaagagtacttttttttttaaattttgttttaattgacaaataataattgtacatatttatggggtacatagtaatgtttcattacatataatgggattagatcagggtaattcgcatatccatcacctcaaatatttatttctttgggttagaaacattcaatattctccttctagctatttgaaattatataatatgttattgttaactgtagtcatcctatagtgctatagaacactggaactacttctatctagttgtacttttgtgtcttttaataaatctctccctatccctcttttcccctaccctttgcagcctctactgtcatctgttctgctttttacttgtataagatcaactttttttagcttccacatatgagagagagcatgtggtatctttttaacttaatgtcttccagttccatccatgttgctgtgaatgacaggacttcattcttttttatggctgaattgtattccattgtgtatatataccatattttctttatcagttaatctgttgttagacacttaggttgattccatatcttgactattgtgaatagtgctgcagtaaaatgtgagtgcagatttctcttcaatatactggtttcctttcctttagttaaatattcagtagtggcatcgctgaattgtgtgttagttcgatttatagttttttgaggaaccttcatactgttctccctagtggctgtactgttgacattcctaccaataatgtgtaagagttcccttttctcttcattcttgccagcatttgttatttatctttttgataataaccatcctaactggggtgaaccttgttgtggtcttcattttcctgatatgtgtgcatttccctgatgatttgtgattttgagcattttttcatatatttattgaccatttctatgtctttttttgagaaatgtctgttcagatcatttgccgattttaaaatcggattgattgttttttagctgttgagatgtttgagttccttctatattctgaatattcatcctctgccagatgagtagttgtatttcctcccattctgtaagttctcttttcactcttgattgtttcctttgctgtgcagaaaagttttccagtttgagataatcatatttatttttgcttttattgactgcacttttgaggtcttattcatgaaatcttttcccgacctattaaagaggttatccttttcctaatgagtggtcttgtcaaaagtcagttggctatagataacatggattatgttcttttgttctatgtgttctattgatctatgtgtttgttctcttggtcaatgggtctgtttttatgtcagttctgttggtctgtgggtccgtttttgtgccagtccatgcttattacagctttgtagtatattttgaggtcagtaagtgtgacaccttcagctttgttctttgctcagtattgctttgactgtctggggttgtatgtagttctgtacaaattttatggtttgtttttaaatttttatgaataattttattggtagtttgatagggattgaattgaatctgtaaattgctttgagtaattttgtcattttaacaatatttgttcttatataagcatgggatgtcattacatatgtatgctctttggtttctttcatcagtgtttttttttttttttgtagaggtttttcatcttcttggttaaactgcttcctagatatttaaaaaaatttttgtagctgtggttaatgggattgcattttttattttttattgtatgtgtatagaaacactacttatttttgtgtacttattttgtttctggcagctttattgaattcatttattggttctaagggttttggtagagtttttaggtttttgtttatataagattatgtcatctgcaaacagggacagtttgcttccttcccaatttggataccttttatttttttctcttgcataattgctctggctagtacttgcttaactgtcttttttttattttttatttttttgtcttgagacagggtcttgctctgtctcccaagctggagcgcagtggtgtgatcatggctcattgaagccttgaactcctgggctcaagcagtccttgcaactcagcctcccgtgtagctgggactgcaggcatgtgccactgcactcagcttcttattcttaatgtttatcaaaatgggggtctcactgtgttgcccaggctggtcctgaactcctgggctcaagcgatcctcctgccttggcctgccaaagtactgagattacaggcatgagccagtgtgcctggcctttaactgccttttttcccacttgaagatgctttgcctttatctcaaactgacctcattgactggctttctcttaactactgtttagggcaaaggtcagcaaacattttctttaatagatcagagagaataaatattgtagctttgtgggtcacataaggcctctgtctcatcttttttttacaatgtaaaaaccatttttcattcacagacctataacaacacagggattttgtccgttggtcacagttcatggacccttagcttgaggtgtcctcgttgtagtttgtcttccacatttagttacaactttgtatttcatggttttttttttttttttttttttttttgagacaaagtcttgctttgtcgtttaggctggagtacagtggggtgatcttggctcactgcagcctccacatcccaggttcaagtgattctcctgcctcggcctcccaagtagctggaattataggcacacaccaccacactcggctgatttttgtatttttagtagagacggagtttctccatgttggccaggctggtctcgaactcctgacctcaggtgatccgcccacctcagcctcccaaactgctgggattacaggtgtgagccaccgcacttggccaaaaagtttttgattgttttgatttgtgtccgttagattctgttagtagagtggagggatggcttaggtaaagttcctgccatcagagatactctgtttctgttgtaggattcagaaaagaaaaaaagaacaggaagttttcttcttttacatacatactttattttctttaaaaaatgtgtttatgaaaattgaacattaaacaagtatgttatgggaagtgggtctggctataaggagctaaaaacagttataaaattctcagttttgtcatctttgcccaaaataaatccaactaattagtgttaaagtaggtgcagcagagcatcccagaagtagtcttgtggcctccccaggacagaactcctccccacccaactgtttgtgaagacaccctgcagaggtccctgatgaactccttgtctctggctgcttttctgttcttgctttctttagagaatgtatttttcccttagccctttgaaagcttttgagacacacagttggtatgccaattatagcattctttatccctgagatctgggggatttcacggtcataaatacacactgttttgaatatataaatatttttctggggagagttgattgttttcatcttaatatcaaaatggtcagtgacctgaaagaatttactgtctatccattcattaaagcagttttgcaacagtagtgttttactctacctatgattaagatttgaactttgggaaacttttttatttcttggtaaaagatgtaaattttttggaatgaaaagatttcagtctaaaccaacaatttatgatattgctctctatgaatctcttactagtgactaataaatattaaggcacttaatggattcactttagctgtattttttcatgtggatatgtgtaaataccttgccataagagtaataagcaaaattgatttagtatatttttgaacaaatgcatttttgctagacctttaaagtttaaggtttctatgggagagtccaactatgttctacaatctacattttggatttttaatttttactagtttactgcttatacaaatctgaaaatttaaaaaattaaaaaacaaccttttttttttttaaattccagatggagatcttataacaatttttgatagttctgacctttcctttgcaattcagtgcagtaggatactgaaactgacattatttggtgagtagtaaactttctaatgaatttactattttattcattgtattttaaagatgtttggcttttttccttttaaagactcaggtaagcaataacttattcaaatattattacatttatttgtgttcaggtagttgttttagattacttgaagcttatggctgtgtatgtttttaagaaaatgatagaagtttaattcagtaagaacagagtgttaagtatgttttttttgaaatcaggtataacttaggtatccctggtgcagtattatagttttaatttagctgtattagaatttttaaattgtaattatcttccttcacattacagtatgttgttacttattatcagggcttaacatgtaagtctgatacttgaaaccagtagtcgccaacctttttgcactggaaactggtttcgtgtaagacagttcttctatggaagggggcaggagaaggtttggggatgaaactcttccactttgcatgtgcaattcacaatagggttcacactcctatgtgaatctaatgccactgctgaactgacaggaggcggagcccaccacttaacctcctgctgtgctgcccagcccggtttggttcctaacaggccacagagtagcactgggttggggacccttgctttagacagtatttcccgaggggtacttaaagattaaaaatagttctgataaaaaccaatagaagactaattttaatcttttagattttttcttttagatcttaatagatatgcaaggcagaactcttaagggacaagatagaaaagattacagagttaaatggtagtgtgattatgtgaaaaataaaatgtgtacactttttccggctgttttgttgttttgtttagcattaattttatttttttttaattttgttgcatgaaacttagagttcagtgtgaaatatgatcatggtctattgatttaatttgtatctatttcatctccatctaggaaggatgaatatgaataatcagaatttaaatgttaataacaaaaactgtttaaaattatttaaaataaaggtatctttttacagtattgaatgtaaaatacttaactattgactaggcataaagcagattagataatctgaagacccttactttaaacaggatctgctagataaacttacaaatgtgttttctgaattctgtaactcagcttgcacaggaaagtaagggaaatatccagggaacaaaaaagtagagggaactaaaggcctgatgtaccaaaagctgaaacttggggtgttcttggtggtgatagtagagattttagcctgcataatttaaggaattgccatctggtgtctacatggtgtaggcccttggtcctagtccctcagtaggccatgctttcaaaaagaatattttagaaaagtctaccttgatacagggaaagtcaaggaagcttaactcttataccttgggccgtcaggggcttgggaagtctcccttcaggattcataattgtggtccttaggtgagttgggtttaaatttaaactatccatgtagtttggtaactcccaagcccagatgttaccattttagaaaaatctcagaagaaaggccaaaatctctcttgaggggtatattctcaatccaggtcacataggtttctcacagacaaaaccgtaagacacatgaagctgtcaggtaagcaagaaccactggacacaactaatagcaggattagattttcaacaacttcagttaagatatgtgatagtctacaaaattaaaagttatttaagacatagaagaaggaataagaatataaaagcagccggccgtggtggctcacgcctgtaattccagcactttgggaggccaaggcgggcggattgcctgagtgcaggagttcgcgaccagcctgagcaacacggtaaaaccctatctctactgaaatgcaaaaaattagccagctgtagtggtgtgtgcctgtagtcccagctacttgagaggctgaggcaggagaattgcttgaacctgggaggtggaggttgcagtgagtcgagatcgcgccactgcactccagcctgggtgacagagtgagactccatctcagaaaaaacaaaacaaaacgagaacataagagcaagatgctattgtattatggaaaaacaataaacagattttataaagaacttaaagtaacttggaaatgagaaatataatcattgaaattaaatactaagtggataggttaaacacattagtcatagctaaaaagagaattagtgaactgaaaaggaaatccaaagaaattacagagtaaagcacaaaaacacaggcaaaagagaagttgaaaatgagaacatccagaatatttctattcagagtttcaagaaggagagaatgggagagtggaaatacattgaggtaatgactaaagaaattttcagagttatataaaagctatagaccctcagattcagaaggcacggggagccttgagcagggataagtaaaagtaaatccccactggacatattgtcatgaaactggaaaatgtcttaagacagagagattaccttaaaagtagccagagagaataagactgatcacatatgaaacaattagactgttagtagacttcttcatagtaataatagaggctaaaagacagtattatcacagttgcaaacagtaaagaaaaataactagaaaagtagcatcctatactccactaaatttcacgaatgaggagaagtaaaaatactttgaaagactgagaatttaccactcatggacccttgttaaaataatttttaacagtggtcttcatcaagaaggaaatttagtccagaaggtggtgaaagatgcaagaagcaatgtgagcagataaactgttgcttggtcagtaggctatgctttcaaaaactattttagaaaagcttttccattgatacagaaaaagtcaaggaagcttaactcttaaaccttgggctgtcaggggattgggaagcaccaatgaaatttatgtgtacgttttaatgagcattgattgttacaaaattaatagtcttagggaataaaaacaatttgggacaaaaatactgggcaataatatgtaagaaaggaagggatgataggaataaaaatattttaaggacttatttgggaggaacattgtaattacctttagatttttttaattgcatactacatatgcagaagtatgcatggtgtacatgtaagagttataattgaaaaattagacattgtcaggaaaggagaaaaaaagaaaacaagggtacctgttcagttcagtagaaagtggtggcggaataaaagaggtagaaagctcaatagatagaacagaatactaatcacagtacacagaaattgactacatatatcggttaaaataatctcttaatggaattttaaaaaaaatccagttccatgctacttccaagagacataaaagattattatgcaaagcttgaaagtaaagggctaggaaaagagactagacaaatgcaaagaaagctggttattaacagaatagacttatataaaaacttgagtagtaatagtcactttatgatgataaaaagaataattcactaggactatatagcaatctgaacacttatgcatgttagctttagatgttttcccctaagaaaaattgacagaacaaagagaaatcaataaatttacaattatgggagagccgataaatcaagcaggctcaaacagcgttggtcttgtacatctagcagttagggagaaatacagtttttttttttttcgagtactcatagtgcattatagaagttgactgtaagtcaagtcttccagaaaatcccaaaatgtaacagataattagatatcttaaaggtcatattctctggcttctttagagactattggacagaatatgtaacccaaatttccctacttttggagacaaaatatggttttaaataagtcaaagaagaaataataatgggaattataaataagtagataatgacttctatgtaaccaagtttttagagaatgctaaagctgtacttagagtagtacttacagccttaaatactttatattagtaaactggattggaaatttttgagcaaggtattcaaacagttacaaaaggacaaacctcaaataacttggaaggaaataataagagcagacgtgaactagaaattggaattgttaggatcaacaattttgaaaagatgcagttggcaaatctttatgaggattagttaaggagaaacaaggcacaaataagcaatgttagaaatgaagtttatagtagaaactttaaaaatttatatataccatgaattcctttatttaaatttgaaaactcaggtgacatggacagtatcctaggtaaatttaatgtactgtttcaagaagtagaaaaattggttgccccaattaacattaaagaaattgggccaactattttaccaaatatctaaggaacagatgattctaaattatacaaactattcaagagcataggcaaagagggaatatacactaattcattttgtggggttaatataacattaacatgaaaaccagccaaggaaaatgcaaaccagtgtcacgtatgaacatagatagaaaatattaagtaatatttacaaatcaaactcatcagtgaatatttaaacacaccagtgtcaaaattgctcacccaaggagtctaagattgctttaaattagaaaatcacatactattttccataaaacagattaaaggagaaaaactagatcatctctagataaagaaaagccattcatatctcaatcatgttgaaaagtcgtagcaaactatgaataaaagggaattcttttttgtgaggcagagtctctcactgttgcccaggctggagggcagtggtgcgatctcagctcactgcaagctccgcctccggggctcaccccattctcccatctcagcttcccgagtagctgggactacaggcacctgccaccacgcccggctaatttgtttttgtatttttagtagagacggggtttcaccgtgttagccaggatggtctcgatctcctgaccttgtgatctgcctgcctcggcctcccaaagtgcagggattacagatatgagccaccacgcctggccaaaagggaattcttttacctcatatgggggcatttattacgtagaacaactgctgtatgcctaatataaaaggattataaatgtaactaaaatacctattataattatatacaacaaaagatacttgggataaatctaacatggcaagattgttttggatgaaacataaaattttttaaaatcaagtaggggaatgggttttgaggaaaggtactctgggagatttaattatgtctatgctgtttcatttcttagtggttaggagcaaagatgaaaaaaatactaagatttggccaggtgcggtggctcacacctgtaatcccagcactttgggaggccgaagtgggcagatcacgaggtcaggagttcgagaccagcctggccaacatggcgaaactccgtctctaccaaaaatacaaaaaaaaaaaaaaaaaaaaaaattagctgggtgtagtggtgcgtgcctgtaatccagccacttgggaggctgagacatgagaattgctgaacctgggaggcagaggttgcagtgagccaagatcaggccactgcattacagtctgggtgacagagcaagactctgtctcaaaaaaaatataaatacatattaagctttaacaaagatgggtgtttagtaagtttatcttgttgtgtgcttgaaatggttcattaaagtcttatgattatattcacactaatgaagatacattattatgtgtgctagggttctccagagggatggaaccaataagatacatgggagttttttagggagaattgcaaggtgattacaaggcgaagtccggtgataggccatctgcaagctggggaaagagagaagctgatgctgatagtggctcagtggctcagtccaagtccaaaagcctgaaaaccagggaagctgatagtgcagcctttgtctgttgccaaaggcctgagagtcccctgggaagctgctggtacaagccctggagtccaaaggccaaaaaacctggagtctgatgtccaagggcaggaggagtggaagcaagcatctggcataggagggagagcgagctaaagacccagcaagcaaacttatcctaccttcttctgcctgttttgtgatagctgcactggcagctgattgggtggtgcccaccaacactgaagatgggtcttcctcttctggttcactgactcaaatgtcagtgtcctctggcaacaccctcacagacacacccagaaacagtactttaccagccatctaggcattcctcactctaatcaagctgacacctaatattaacttaattaatttaaacttagctaatttaaacttttaattgagtataatttggagcttagtgctcttaaacccactgagtagataataacagattataggccatactaggaatgtaaatgcaaggttcttaaaagttctggtaagatgtatcagtgtgctccaaagaccaccaggaacacacctgtagttgaatgaagttgggtttactgacttactgcagcaagggagaatgaataccacggagaacaataggatgtcttacaagtatgttagaaaagtatttttttttgggcttgggtttgtgttacctgattttggataaggttcaaggaagtagagctttgctctgcattggatgctctcaggaagtagagatgattctatgtttgggtatcttatcaaatcttatctagaaggtgagaggaatgaatcttactaaatcttatctggaaggtgagaggaatgaattgaggctaaagctgcagttggtaaagtagtagcagttactcatattagccaggataaaaggttgtttggtcatttttctggtgtggtcagtgttcttgtttttgtctggagttttgacatggttatggactgttgatctatcacagattatagtcttgtgtgatgttggtgttctttgaaatatttatattcaacgggagaacaccacagcctacctgtgagtgccaggccagcttccagcaacactaaggcctgtcttactgtaccagaccagtttctggctgctaggagctgtttttctcatcaaatattggagaaaaaacagtaataccaagtgaaaaccaataattgatgtaggtaggagattgtattgaacttcatagctatgcagggagtatgtgaattactgtgagttttcttctaaaagcttataattggtggtttgattttgaaacatgtttaacaaagaatcgccctgaacttttattttcacgtagatgtccttttctaattaggtgcttcaggagtttgtatgtatgtatactggcaatgtgcaaagcattttagtttaatttttgaacgcctgtcttggggtttgcaatcagagccttgtgtcactttctttttaaaaataacctgagtggtgacagtgtttgttgctgaatgaaggatttcatttttttcagtcaactgaaaatcatttggacaaaatgaataataagtgaagtaatgttgctttcattaaaaaatcacaactagagattaccgagtaatctctggcattttgtggcttatatactgtttctggaagtaactgctttgaaggacagtcatgatgtagataagttctgcatatatttttaaatttatatttattttttaaaattttttgagacaaggtctccctctgtcatccaggctggagtgcagtggagtgatctcagccaactggacttcccctcccgggatcaagcaatcctcccaccccagcctcctgagtagctgggactgcaggcatgtgctgccacacttggctaattttttaaggtttttgtagagatgaagtctcactgtattgctcaggtttttcttgaactcctgggctcaagcagttctccctccttggcttcccaaagtggtgggattacaggtgtgagccaccatgcctggccctgcatatatttttttaacgatttcttttaagatcagctattttagttagctgttttttttcaagacaaagttatgcaagagggataacagacctatcagtcatgttatatctttaaacatgtatagagtaaggtatttttgtattattttaagaatagcgtgaaataaaatgagctttttaagttatataatttttattaaatttaataatttctattaaatttaataaatatttaagaacagcatgaaataaagtgagcttttgaagttatgatttttattaaatttaatcatttctattaaaaagtagagctcggattttcctaccaaacctttttaccagtaaggtcataggctataggtatggcatcaagaaagactgataattctgctttttttccaaaataagttattagccatagagaattctttttttttaaaaaaaaagttactccattacattgatatcttgtttttgtttttttaaaggaattgtatttatttttccttgttgcatattattagtatacttattcatgaacttctaattttaagcaaataaatgtttttatttcagttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatggtaaaccctgaatccattgtattctgacttattgttcttacgtctttttggaggttttaaaaaactctttttaagtaggagaaggatggcatccccaatgtcactcttgtttcttcctctgcctctctactagtatttatgtctgtgttcctaaactttgctgttcatcagaattactaggaggtttcattataccaatttctggatctcatcatagacctactggagcgtagcacctggaaatcccatttttaaagtgttttttgggtgattctttcgcaactagtcttagacttttggatttgttacacaggtcagttttcaaatccttttgacacatgaaccctttttagtataatagataagtaatgaaccttgggaattgaaaatcatttcatgaataattacatagtgttggaagtattttcaactaaaaatcacttagattagtaatgttcattaaaaatggtatgttgtaaatttgaaacacagtttttaataataattaaagaaaaactaattttttccccattgtataatgacatgtactgtttgtgttaagataaagcaaaatgtgtcaacatttggaactgacataattttgggaccgaatgtattttaaaatgtggactgacctttaagtatgtgttaatgacttgaaagtacagttaaaaaactgctttcttcttttaagattcttagatgttgcatttaaagaaaactcttattattatttttttctttttacaaattctttgtttgcttataattttcatagtttaaaactgtccatattgtgaaatagtaatttaaaaaaagtctagactggatgactgcatataaagggcttaacatgagataatttttgtggataaatggtatgtattctatttttggccactaaatattttggaagtttttgttttctatttttattttagttacagtttaaataaagatgtattttccatcatttctctcttcctgtcttctaatagtcatatggaattatgttaatgatagatgtttaataaatatttggtgattgattattcctagttgcacttctatttcagaacataatggagatttgctgaatactataatgagatcctcttggtcactttatgatgaaaccttttatatttcaggtcaaagaaggttgcctattctgagccctacctctccaaacaaaaatttccaattttagatcaagaatcaatgaaaaagttagacaatttttccagaagaattcatagatgctgacacaacatttgcatataatttcaggggatttaaccatctgcagaatattaagaagtgtagatgagaatttaaccagtatagccaatactgttcagaaattagctacagtggcccacattctactctaaggaatggatttatgagttttttgctttaggtgaaactttttcctcacctctttcttgctactgtttatactttattctttgtgtctatattttttatacatactgttagctttttacctatgttaatgtaaaaggtgttaaaattggtttcttctctgcattttggaaatcatgccatatgttgttttcttgtatggccattttctagttattgtgtcctgtctgacatatctgatgataagatgatataagaataatacaatctgcattatatttttagagatagttcttatttttttagaaaacaaaaacaacaagaaaaccatacatcagaaactgaaatctagtccacaaaatgaaattgccaatcagctatcagtgctatttagaacctgtggcttaccctcaccaagaaatgtggccacctgtggtcttcagctctctattacagcggttcttggatgcttgttttcctttaagaggcaaatgatgtgtaaactaccttagatagaagattgacctgttgcagtatctccagcagctaatggagcaagtagtaggacgtatagtatgtttcctgatggttttagtttgtgataagtgaaaagaggcataggtagtgagatgtgaggggaaacaacttgtaagactgacgtggtatgctcttgggattagaggaaggaagttggtagggaagatagataactggtagacatgttttaaaggaatacttctagtagtagttttctttttccaaacatttagaaaatattagggtagcctggaatggtatgttaggaatgaatgagctgccagccagtgtgtgctgtgggtacttatattcggtttagcacttaacatttttttcagaagatacattttgtattgattacaggggtgatctaagaactgatgttcatttacttgcttggtaacaaaagtgataatcattgtcccttaattgagtaaatggttagcaacagtctttttgtttacttgttcgtgttttttgtttgtttcttttgatgtcttttgtatcttggacttggattcctatttgtaaaatgtatgttaaaattcttgaactctttttctttcacaagacagtagtataaatgcctgtggaatatcttagtatcctgagaagaaaagcatgattttaaatttaacctgctcataatatttgacattttgtttttctgttgttgttttaaacattttattatagaaaagtttaagtatataagaaagtagacattataatgaatcccagaaacccacatccagtttcaacagttaccaacttatagtatcatataattacactatacacatttccgcccctcctgttacccagagtggagtacaatctcagctcactacaaactttgcctcctgggttcaagtgattctcgtgactcagcctcctgagtagctgggattacaggcatgcatcactgtgcctagctaatttttgtatttttggtagagattgggttttgccaggctggtctcgagctcctgacctcaagtgatctacccacctcggcctctcaaagtgctggaattacaggcatgagctgttgcacccggctcccctcctgtattattttgatgcagatcccatatacatcatttcatctgtaagcattttaataagtattttaataagtaatacatattaaaatagaaggtagcaaattcaaaaatgtttttaatgtgctatttatggaagattatgaattaattatggttggcttgatttccatgtaatttaatagtggaccagtagacagtagaaataaaatgtaaaatttgagattataaccttagttcagtttctttttataaaataaagccttagttcctataattattttttccagagtgcccagtgggtatctgatactaggatataggttattgggctccaaaaaaaccaaaaaaagtaaaatgtttctctttatcaaggagcttgtatttttttcatctaatgtttcttacaaaaggaggtaaataatttttttggaaagcttttgttcatcttctgtttctttttgccctcttctccctgttactagaaggaaaaatataaaaaaaataaaggaattaaaatgatctgtaatcctatattccgacatgcttaacattccagactatcattatacacctgcattatttcccttgtacttttaggccttactgaatatagataaaaaggaaacaagtttttgtttattcctctatttttacagatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcaggtaagttggtttccaactcctttacacccttcgtttccttcatctttccgttcttccctttccttctttctttaattgaagaataacttggatatggtgaagtgcacaaatcttaagggttctgcttaacaaatttttacatatgtgtacacttatgtaaaagactaactagattaagatgtagatgatttccagcacttcagaaagctttcttatgtcctctccccaagagtagcaccctcccccttaaagaataagcactgttgggttcaagtaaatttttgaaagtaaaatttagaaagtttttaaaaatctgaactattttataatttgattagttgcagtattcgaattatatttgatttgtcttatctcctcatcttagagaaattgaaaattaaatgtagattttcttgttaaattgcttgagtatacagtgggtttttatataaataagtttttaaccttaaagcagtacctatattgttttattctgtttaacttttggttataatttcttcattattttttcctgctttttctcttttcggattctaataacacatacattggagagcttgatactgtctcatgggtcattaaggttcatttttcttcagtcttctctctgttcttcaggttgggtgatttctgttgaactcttcaaggtcgctgtgatttctaatatgctgtggaacctttctagtgaattgtttaattgtgctttcagctctagaatttccattgggtttttatagtttctgtttttctgttgagattctttattttacattcattaagtctatattttcctttaattgtttgaatgtatttatgtttgattctttaaaaatatttagctgctttaaaatgtttatctgcaatatgtaacacttggacccatttggagtcagtttctattgactgggttcctctcccccacacacactccccccaactccagtagggtcacatttttctgtttctttgcctgtctgatagtgtttggttgaaaactagacattctggttaatatgttgtagtgacttggacttatattcttttgaggattttctgttattgttgatctagcagggagttgatttgtatggacttaacataaataacaaacagaaaagcgctctctaaaagaaaaaggtatttgggaatagagcattgcattgaaaatatgcatgccatagtaaactatgtgcatattcagtgaggtaaaggcagacaaaggtttttaaaggaaaaaatgaggagaatatataattgttttgaaataattattgttggctacaaagatcattagcaagagtgatgccagtctgaggttggacaggcagtttctgggcagatgtcctcacagtcacagaagtttttttttttgcttttttttttgcaaagttgtgatggcctttgtgtaggcttgtggtttttgaactcttttgtgatagtttttgcaagaatcctctcttcatggccttatcagagtttttaatttttttttaacattaatgacttcattttggttttgataactttcacatactcaaaactgctccttctttctccctatggtgtatagcagctgatatgtatgctcagtcctttcagcttgctctaggtgctgcatttttctctgagccttcttgagatatcctcgtctgctctcccagccctatagtcagctggggatttggacagagtgtatatacctagatcgtgggtcttaccctttcagtagcaccttcacttccgggattttcctcctaaatcttcagctgcttgtctagccataaggttgttaacactgtggttttctgccattggagctgcagaggtcagcgcttttaattcttatccattctaattttattggggtaaactcctctggtttctgattgactttcagttatttcaaatagtttcttttgttttgttcatgtttttagttgttacctgggagagagtttatctgatggatttactttgcctttatcagtagttggaaatgtgtacagtccattttgtatttcttagagactttcatggaattactcacaaaagagaattgtgtgaaaatttgatgaggtcagacttttaaattttgatttaaatgtagtatattccagactagaataatattaatatgattcacattatttgaagaccatttttctcacagctttgtatgttgaattatagtaggaaaaactgtatgcatagctaggatacttttgtagttcttcaggtgtgatgtggtaaaaatgtggcttattagaataatgaatgtggcagtgggaaggagggataaaatattacaaacatggaatgaatattaactgtaataaattacatataagggaggaaagaggagccaaagtaataaatatatatatttaggctaataacagtgtcttttgtgggaagaatgtgtgtatttatctacatagatataaatttaagtaaaatggtggtagatagaaaccatcatccattttattttggcaatcatcagtctctcttgcattaccactattatatcctagtttaggttcttattaatacttggactgtcagctgtcaactgtgcctaatactgtggtaagttctggggatacatcagagcagaagatagaggtttgcccttagagaaattagtctgctgataatagcaagtacttatatggaactttctgagtagtagtcacttttataagcttttgctgtataattccttttataagcccatgctataagctcttgtaaactcataatcctcacaataaccttatcaagtaggaattagtatatcctttgtacagatgaggaaactgaggcacagaaagagattatgtaacatgtccagagttacacagctagtgagtgacagcactaggatttgaacctgggtagtctagctccaaaacctatgcttttaaccactcttctgcattgccaaagcagaaagaatttaaaggaataagacatatttacattgtcctcagaatatcttttttgactgtcacagcattggaactgtaatatattctctccattcatttctgtgttcattattttgtaagaattatagtggctccatatgtaagttagagtgctaggccttgttcggcagacaaaaagaatcaacagtcaggagcccggccaaaagagtgcagagtctttaagagggaaagtgagagctattcagaaatgcaaagtagaagtcagtatgagttaacaaaagtaaactagatagaagttcactagtagaaaaagtattcatgagtcaagaaggcttactagaagtgtggaattataattggattttaaataatgttatatttaaatatgtgaatgttatatttaaatatatgggatctagtgggagagaaatagaggtcaaaaaaatattagctatgttatgggagtagggagaaggttagtttagctgaaagggaggcatgtgagaagagaaattgtgagaaataatgtttggacccttaatgccaaactaggaggttgaacttaatttatggtcagtgaagaccccttgaagaatgaagtgacaattttggttcctgtgcagaatacattgcttggagtagggggatattggcattgcagacatgagttttgatttttgcagggagaggttaagactcaggaatatagtactctacactttataaggaaggagttccagttgtagctttggattaagagattggagcaaaggaaaaaataaagtacatacatttaatgtaaaaaggcgtatttgtggttatatacttattctatagtacttttagtatcttttaaccaaacttattccttgagcttgctgggggaaggccttgtgttggatactaaactgacttttttttgactatccagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtaaaatagagtttagaacacatgtttgggaaagtacatgtgtagaagtgtttattacagcattgttgtaaacacttcatgtatttagtcatgccttaaacacaggaaaaattttgatttactgacatgatttgatgttaaaaaaccaaatagaacaatatgtcaggtatgtttccaattattggaatgaaaaaaatacctcaaaaaagtgtttctatgaatatagatacagagtgaaagaccagtcattagtcagtggtgacccttggaggggaggatagtgaagttcagactggtgatttcacactttattttgtgttatagatgctattttatctccctcctttcttcaacatctgtgcatgatttttctaatttaaaaaagatttctgaatagaggtaaaggataactttagttgtagtgggttttttttgttaagattagtagccttttataattttgtaaatttagcaatatgtctttaatggaaaaaaagcagtgtattttaagtcagactttttcttctgaaataatctgtccttggatatgcagtttagtctctctgggttttgatattctttcactgtaaaatgtgaaaactggactgaacccagtggtttcaaaagaatgtctttagttctgaatgaaatataacctgaaagctccatatttaaaataggggattgaagggcaacagacttcacacagcaggcactaaggtgcctcattgaaaaccttggagttctgcagaatgtgactaagtacttaactaatctctagggtgccttccagataatgaagtgtgatttttgtattgtctatgtgtgttgggacctttaaagccgcattccacttcaaaacaaacaccaggtggtgctctaactatttgtttaacgggtcagatagtggtataatgtatttccagccccagaagcaagtgattaaggttatcaattacattaaaacaaaaacaaaacataggctaaaatgaactgaccacttttggaatagaatcctatcatcctgtggtgatactttcagagttacctggctaggtgtggtgcctcacgcctataatcccagcactttgggaggccgagccaggaggatcacttgagcccaggagtttgagactaggctgggtgacatagtgagaccctgtccctacaaaataaaaaaagatttaaaaaaattagccaggtgctatggcatgtgcctatagttccagctacttgggaagctgaagtgggaggattgtttgcattgttgaattgaagtgggtggtctaggctgcagtgagctgtatcactccactgcactccagcctgggcaacagaacgagaccctgtctcaaaaacaaacaaagccaaaaaaaaaaaaatccacagagttgtctgttggatgaacaccagtcattatggactagcaggtgacattttgctgatgaatcagtggtttgcgaagaatttcttattgcttaagccttttctcaaccaactttaattaactcctcctctgcaccaaaatgctactgccaaaactagaacaaactagaactaaagcagatgtcagctgaaatggacaaaagcagagtataggtatgatgagagtttaatgcctacatcaagcgaactaaagatttgtttttaaataaatcccattttaagcagtgtatactgtgatacaatgacagttggaaggatcattgtaccaaataatgtttgctgtttatgtataaataaatgggaattaaggcgctactagcaatatctaaacattctatgaagtgtttaattgagcattttcaaataagtaaaattttaaaaatgcgaaaggacatacagtgaaaattctctctcccacctctgtccacagcaaccaaattccttttttcagaggtagcagattaacactgtttatatgcatttaatttttagagtagtattgtatgccttgctgcaattaactgttagcttacattaaaacatacagtatgaaaattgtacaattaatatgtgacatcatttaaactattaataactgatctaattctagatcagtgctgtccaaaagaattacgatagaagccacatgtagtttttctatttagcagcattagaaaaatgtttaagaaaaggtaaaattaattttatttagcctaatgtatccaacgtgtactcactattaaaaagttaatttttttggtactgtgtattggaagtctgggatttgacactgatttggaacacttcaaacaacaaacaacatatcacatttcaaacaagccacatttcaggtgctcaatagccacatgtagctagtgattattttaagagcacagctttagataaatatagtcgttatttatagattcccagcatgaattataggctacttttactttttgttgtataatgagtctttgacattgtcagttatttagatcaactactggttataatttgagcagaattaccaacataaaatgtattacttataatttgttaacatagcaatctcttacaatgtgttaatagtccatactaaaattaagaattctgagttgttacttaactcccataaaagggactttggaactgtgaattttattccaaataaatgtagtcttaatatgtttttcagttaaaaggatcaacaagatattgagcatcattaaaaaaaaaccaaaagggataatgttactctttttcatataaagccagtgcctgttacaggaagactatgtgatgttgccagaaatgtaactggtaaggagaagaacgctaaaaatcatcagagatcgggagatattgctgtttgacagcctaaaaaaatgaaaaagcatataattaaaatctttaaaatcatatgccaatataatgaaaagctgagtagcctttattatgtaaatattgaaacatacatagaataatcaactcttcatgtagtcatgtggcttcaacacttaccaatattttggcattcttttttcatcattttttccccactgcaccccttttaatttgctggagtagtttaaatcaaattatgaacagcttattatactcaggtatttcagtatatatgtccaactgataatcttctttttaatataaccaccatgctgttacttaacagtgattctttttatttttaattgtgacagggtgtcactctgttgcccaggttggagtgtactggcttgattacagctcacctgcaacctcaacagtgattcttaatgtcaacgtgtgctagtctgtgtttgaatttccctaattgtttcaagattcgtttgttaaattgacttgttcaaatgaggggcctaacaaggttcacactttgcattgttaatgtgtcttgagtcgttttttctaatagccattagaaaaaacttacatgtttctaaaatcccttacatgtttctaaaatcaaaactatgtgtattatttattactgtgtaactattatcccaaaacatagatacttagacaacaaaagttaattatctcatacagttttagacagatatcccggaatggtttagctgggtgattttggctcagcatctctcatgaggttgcagttaaaaatggctgctggggttatagtcatctgaagcttaaccagagctggaggattcagttctttaccatttggacttctccatggggctgcttgggtgacctcatgacatgacagcttcaccagaatgagtaatcagaagagagtgaggtagaagataaccttttatagcctgtcctcagaaatgtcactgtcatttctgcaatattttcttggtatacaggtcagccctattcagtatgtgagggactaacagggagcagatactcatgtgcttgttgcttatttggtcatttttgtattgtggagttaaatctttctaatttctaagaatataaacgataccaacccattgtcataaatgctatacatgtgcagaagccgttgagggtcatgatagaggttggctactctgtgtaataaataattcccagaagtcttaccattactctttgcttcatcctgttctcttttccccttaattttttttattactttttactttattctgtcattgattctttttgaaaatatacataaaacatagcttatatatagtcatgcactgtataacatttcagtcaacagtggactgcatatatgatggtggtctcataagattataatggaggtgaaaaatttctattgcctagtgatgtgtagccatcataatgtagcacaaggcattacttacgtgtttgtggtgattctggtgtaaacagacttactgccagtcatataaaagtgtagctcacataattatgggtagtacctaatacttgataatgatgataggtgactctcttactcatttgtgaatttactatactatatttttaaatcattagagtgtactcctacttatttaaaaaaaaacaaagctgtagaaccaggctcagataggtccttcagaaggtattccggaagaaggcattgttatcataggagatgagagctccatggatgttcttgaccctgaagaccttccagtgggacaggatatggaggtggaaaatagtgatatcaatgatcctgatgctgtataggcctaggctaatgtgtatgtttgtgtcataatttttttctaaatgtttaaaaaagtaaaaatttaaaattaaaagaatagaaaaatgcttatagaataaggatataaagaataaatatttttgtatagtagcacaatgtactttaagctaaagtattaaaaaagttaaaaaatcaagtttataaagtaaaaacattacagtaagctaaggttaatttattgaagaaatggaattttaaaaaataaatgtagtatagcctaagtgtatagcgtttgtaaacctttagtagtgcacagtaatgtccttggccttcacattcactcaacacaagtacctcacttggagcagcttttaatcctacaagctccagtcatggtaagtgccctaggcaggcataccattttttatcttttttgccatattttcactgtaccttttttatgttttgatatgtttagatacacaaataattaccatgtgttagaattgcctaagtattcagtacaggaacatgctctacaggtttgtagactgctatgtaccatatagcctagctatgtagtaggctatatacatctaggtttgtgtaagtatactatatgattatacagtgacacaattttcagaacctactcttgtcattaagcaatgcatgaccatattttttattactcaaaacattgcttactataaacaatgtctgcattttgctctcttcatatatcctatagatctctcaagtatgtgaagaagttcatcctttttctttttttaaacaattaaacagacttcttaattaattttcagaatactgtgacagtcccatttggacttgaatgaggtgggtttaaagtaagtaccgtaaatcctcacttaacattgttgataggttcttggaaattgtaactttaagtgagatgacgtatgaggaaatcagttctaccataggctaattgatatgagtaagttgagttcctacagcatatctctgatcacaaaaatacccccagacttctagataaagactaaaaacaaatgtgagttatagatacatttaagaaagattaataaaaacaaataagataatgatttatgcagttattccaattcagggttgtgggtggctgaaatctatcccatcagctcagtagcaaagtggggaccaaccctgacaggttgctattccattgcagggtgcattgcaaccacacacacacccatagtcgttcagactgagatcatttagacatgctaagtaacctaacatacacatctttgggatgtgggaggaaattgaagtgcccagagaaaacccacacagacttggggagaatgtgcagactctacacagaacagtaaccccaactgggaataatttttttttccttctcagtgttttaacgaaacaatgtcgaacaaaagatgttatttgaggatctgctgtgtaaaaggaatcttgtgtagagatataataaacctctgaaatttttaactctagggatgtttttcaaaatcaatttatagcagtttatgaaaacatgcaaaaaaaaaaagctttatgaagagttgtaccctataaatttttattgaggggaataactgtggttttgaccaggagttccttactcattgatgaccacagtctactactacgtggaaccttaatctcagccttttttgatgatgcccaagttaatatttatattgttttgttcatgggataatatatgcaaaatgactttataaactaaagctttggagttatgcctgagttccagtgatggttcttagctcttcatggttctgttcttagctattgactgcaggtaagttgcttaatttttctgtatctgagataaggaatactaatatggttgaatttttttaaatgtgtttattgcctgtttgcttatttttttattgtggagttaagccttctaattttcaagaattaagagttcattgttatgtgctatacgtatttattccccttgattatatttctgtacctacttacctttttattttagattctggtcacttctattccgaaagttagttatgaagtacaatccaggattaaggtggcatctaaatttggttaatttctgtgctaccttttatgctattagtctaaatcattaagaaagcatttaagaaacttttgtaagcgtttctttttttttcttgtcatatttgggaataggataaatagcttaaaatagttgagctgatttttatttgtattctttttttattataaagaaacatttgctaggaaataagctggatataaacatagttgtatctcctttagtgctacccagcactaaaaacttagacacgtatagggctgagcagctggtataatagagtgggctccgtctcattttctaagcctgtgagtcctagctgcctactgcagctcgatttgagtgggagttgatataatgtctttttttttttctcacttcagcagtaagtatctggtttgctcatagtcttttgattaataggtagtttgaatatttttcaaagaatcagccaacatgtgattattttaaagatttaaataccagatagatattaaaatgcaaggttattgctactagatattacatctagctaaatcaaccattgtgaaataattgagaagtagagataataaagacataaaccaataaatctttgcttgaaaatcacaggtatgggaacagattgtgaggacagaaaaataaaaagtaaaaagaaaaatcataggtaataagtgtctaaagggtttcttcataggaacagtggttgttgaccccaaataggacaaataggactcccatgttcaagaacacatcaccgttgttaaaaaggtctgccattattaaatagtgcaatgaagaaccatttagactttattagagtccacgttattggcaaaagatgttggatattcatagaaaatcaaacttgacaaattccaaaagtgtctttcagctctggaacaaaagatgtcatatagttccttgctaccaaagagtttgttcatatggtaatagaggcccatacctttagagggcaaatacagtgctttaggaaggacttagatgatataaatggtatttgtcccttttctcatttttatttactgattttcaactcacttggcttttaatgaacattagcgttacttatctgttggcagctgggttggaaaacatttgtttttctagactttatgaaatggtagccactggtgttgcacttaatgtttattgccagttagttctctgcagttaatccacagcagaggaatcacacttctaaaatggttcattctcttcttcatagacatttaaagttgaacaaatactttcttgtatattgttactctgtttggatggagagggaatgtatatgtatcttaaaaatatttctctttgccacattaaacatgccttttttccttgtgtgtgtgtgtgtgtgttttcaggtcagatgtaccaacagtaccagcaacaggccggctatggtgcacagcagccgcaggctccacctcagcagcctcaacagtatggtattcagtattcaggtgagcaggtgttgaaagggagttggctcatggttttttgtttctatactcattaaactttaagttcttaattccttgatttgtagtacattgatataataggtattaagtttttattaggggaaacaacatttgttttatttatttttaaatattttacattaatattgtaaatcaacatttcagttttctggtggggagataaaacttacagtagatgattctgcagtaacttgtagtataaaaagtttttaatacaaagctgtcttactaacattatcagtttatctcttaggcgacttagtgcaagttttcccccttccctccacctctccatttatatgtaacacgtaattccagtgtactcttagtacctgtagaaatatgaacagtttactatacatggaaaggtgatgttatttaaataagagctcaattaagctacttagattttaaaatctcttgcaagtatgtaggaataccagaaataggccataaaaataaaatcgtataaaatgtaattcaggcaactaagaacattgtttagttgttttaaataagcatcctgagtattttgtttctattttaccatctgtccactgaagattatatgtatttaagtatgataaatattattaatgtaactttggctataattccagtattttttacagttatgtcagagagtttgtgtccaactcttgttttacagccaaagattgaagtatcagaatttcaactgtaattagaaataatttatgcaggttgaatctagtctaaattctattttatagagttttgtggtatcagctagagcaggagtcagtaaagtatagcccacaggccaaatctggactattgcctgtttttttgaataaagttttattggaacacacttctacttttatattctctactgctacttgggcactagaatggcagagttgagtagttgcaacagaagaccatgtggcccacaaagcctaaactatttactatctggctctttacagaaaagtttgctgactcctgacctagaccataacattctgtcattaattaaaatttgaaatattttgacacaattttatttagattgtatttgctgtagagtgacttaacttgtagctacttgtttttaattgtataaaatacatagaacttaagtttggattatatcaggaggaaggttatttttaggatgcagttcttttaaaaaaatcagtgttacaaactatgttatttatagaaagaatagcagagctgaagagatttagtcatcatttaatctcgggatttcggtcctcactatgctttagaatcacctgggggaggctatgtgtggggccccattcccagagattttgaatttcatttgattgggtgtgggactcaggcgtttgcattttataaatgaggcaactagttttgaaagagattgtgacttgtcaaagcacatacagccattcagtggagggagctggatcagttcagtatttccctgtatcattctgcattctacaacctagactggagttggcagacttactccataaaaggctagatgtcctatgtattaaaaaaaaaactcacataatttccatatttccatttttttgctatttctgatgtccttcacctaaagttatttattattttggagggacggaagggagactatatatatacacacacacacatgatagaagcattgccacattatgttcaagagactggtgggctgctaatgaaatcttcagcctgtagggttattccctcccctaagcaataattaaggatcagattacttccaggcccagttaaaaaaaaacaattcagatttcaggtgccaggatgaaaaggcacttttcttttttctcgcagtgttaaaatgaataggcattttcagtataaagctgaatccatctatttcttcaaaaccttatagtgaaaatttaagttttatgtagaggataggagaacttgtatgacattcagaattttttatgagttggtttcaggtcagtatttagatgctaccatgagttaatgcgttaaagatacttgatttacttattaagaactaagcttgctcttaataaatttagtcagggtcttcactctgagtaaaatttagtcttttcaaattattatctttgtatttctgatcctactagtctattaacttgaatttgattgagagatatggaaatagtcaactaaatactctgcttggagactaagaggtggtggtggtaacattggaccatctttgacactgttggtttgccagtttccctctgaccttttccagttttgttcatggactatgtcataaaggtttctttcatgagtaaattttgaacccaggttcaaggtgagttcagaatatactcaaattcattcaatcctttttttttttaatgcagggttgtacatattttaataattttcttatgtatctggtatttaatgctgacaggattccagtcaatggagaggtttcattgcaagtagctgcaggtgtgtttcatggtagagataaaagttttcagtgaagcagactttcgttgtaaaaaaaattacatcctagtaaataatgaatatagatgttgctttttatggggcaatatggtatgctttttatgtgttatgctgtactgctaagtaaaaattttgagttgtaaaggcaaaaaacatcagataccaaatctaaaaggaatgattttaaagattgtgaaaatggtactttttatttatttgcaaaatttaaagcacctgattagtacaataagatgtatttatagtattatttcatataaaaatgttcattctccgcaatgtgtttttatttgatactgttaagtaggtctcccctgaaaacctggttaatgactatttagctttcccatttttggtcttcctagaaagtataattctttcatttatcatttgagcatctgttctaggaattatgctatgtcaggaatttgctctcagggattatgtcttagagagtttaaaaaattgtagagaatgcctctttgataactacttggtcttgaaatattatgtgatggaatctaccactctgcttgttacatacatatttattaaatttctcaccatttttggtccacctaacagtaagactaattctttggaaaagtagttttactaaaagataagatacatgttatttattttgccttttcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatta

SEQ ID NO: 4 - DNA, 163199 bp, Homo sapiens
  misc_feature: EML4
ggcgcggcgctcgcggctgctgcctgggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctaagcccggagcccggcgctttccccgcaagatggacggtttcgccggcagtctcggtgagtacggctggggagtcctgcgtcttctgcgaagggtaggaacttttttccttccgcacacagcccaggccctgccctcccgcctgcccctcggggtggcagcggctccactgcacatgttcccttcgaggctgccgcccctccgcggactccggtggactgagggcccctcccccatgtccaactctcctctgtgtcagaccctcctttcctcccggagcccctttcagtgcggggccctcgttcccccaaagtgggaaccccttccttctcaggccccccgatagctggcacacccctccccgtacactcacggctccctccacttaccccccttcagagttgggacatttcttcaaatccaggctcctcttcagggtacaaccttccaccacctttccacatacacgcctctctttcagggtggggatcgccttcacccgaacagaggctcctttttaggggagggaccctcattccctcttcaggaagggggcatcccccgcccccaagtcttcactttagatttgaaggcgactttccagtatccttcagagtagtaggcaacttccttttcaatccctccacttctctgagcattttgcagtggtggagagacctagaagcatcggagcatcatttgcttaatgcaggaaaggaagaggtgcatctgtgttgggggaccctctttaagagtgaaagcagaagtgttttctggttctgcatacatgctggggagaagtgattctgcccaatgaatcaataggaaagggggcctctatcagggaaggaaaggattctccatttttggaagatgttgtctttgtggaatggagaaagggaagaggttattaaataggctgaagtgccttttcagtgttcctttcaccagatgaaggtaatcttctggctaggaaaatcaaaactccaggctagtattcgctgccctagaagctgaatctggaattactattcttcgaggccattgaaatctagtaaaagattaagttcaactgttagaatggtgagagaaacagtttcagctttggctgataacgcagttgtgtgatacctactgctggaactgtattttgagttttttatgtgcaggtagcttgtattcagacgcctttcttttacatttcttgataataagtctctacttggttaatgttcactgatcagtgagcagtctggccataggccgtactatatccagataatatcgagatgagatggatttttaaaatctaaagtaaaaaagtaagtcaaagagcaatgggcctattatagatattaaatagtaaaacctataattttggccttccctttttcttgggcagaaaaaattgtcgttatattgctttcagagtggaaatcctaaaataggaggcaactgagtgttgtgttactctttcctcctcaaaggcacctgttgtccattatctaacctttgatgtcttgtaattccttacttaggttgggctctttttagagagacatccatttttccctggttcttttttagctccatgcgttggtttattcacagtaagtgttggaccgaaaaacttgtcctatatgtccgctgaagggctgatcttatactaaagtaaaaattgagtgtcttcttaggggatgttgtggagagctgtgctatctttatactgtattgggtcctcatcctgtaggagtggtgagatcactttaacttctttcgtgttggctctaaagatttctggagggcttgttaaagcttcatcttctgtaagtgtttaggaggagtctttctcaccagttggggcacttaatgtttattttcaaacattgattatgctttgtaatagctttcttctttcttaaccagtttatgaggcaagtgatacaaaagaccgagagatgaagatgaattgcagttggggctcacacttttcataaagagcgtcattgttgaccctaatgttggatttaaaaaattcatttgatgccatgctttgggtggtatgtgatgagactttcctttagatatggtgttaatcaggagcagaggagatatgcctatcagaggaacctgcatctgcagagagggaaggaaatggttcctggcagtatttctggagctgttcttgatgaagatacttctcagtgggagctctgtgctttctctttctgtcccccttgcaagagtaaaactaggccccatcttaattgaaaccttaaaggggtgggggaggagtagtgctggtatattttactggtagtctttaagcggagctttgctcagctcttgccaaattgcttgtttctgttctctgcagttaattagcctagagcttagagttacattgatctttattttaccatcaggagagccatgaatataaaggcaagcacttctactctagtaggtgtttaaaaactttttttttttttaaacaagaagtcaaaacgtgaagttcttctggggttacaactattgaaagcatttattctcaaggaagtatgtgtgtatttccttttacatattagatagattcttgaaaaatggtgaaaaaactacatttttataagcagaaaaattgagtactttataaacagaataattttagagaagagattatttcagagaatcctatggtgactcattttgtgaagtgaaaacttaaaattcaaactgtacccttgattgttgcatgtttagataagaaatccactgtgttatgtgcattttataagatgtctaatggcaattaagactaggtagtggttttttaaatcataggaatgataagtgattggccattttataaatgccacattgaagttacatggtactgattatgttatctttgttttacataaaaaacaagtgaagaattcttttaatctccgcagctgatgaatttcaggcaacttggctggcaggtgcttgtactctggaatttcccttaggtattattaatatatcttttaatccacaaattatggtaacttaaggcagcactttagaaacctttttttttttaaacttaggagagaaaagtactcaattaccttgatgtgttgcctctaaatcactacatatagatacccatgtgcaaaatgtatatactgtatgtatattaaatctcaggtctatgtgcaaaagtgggaagctattcatacagcttttaccgattttttataaggcagggattgggtgcatttcatgcttaatctttttagaatctctttcataatagaggtttaattttaagacttttatcttggaattaacctagagattagtctgttttcacttgaaagaaaccttatacctaaccagtcagctttaaatttttctgcctcaaaagttaaacaacaaaacttaaaatcttcttccccctaagaaaaatcatagtgaatgaaattgttggattaggatctataagaaacaacattctgggtacaggttgtaaatgtgaacaagtatagcagtatgcttcaacttatggactattcagaaattagtctttttaacatcacattgttagaactgtgatttctcatcacagataatagtcttgctttcttaaaggaacaatgctgtatatgattttcacatattaatctaaagcattccttatttacatgaaaatgtttttcatgtaatatttggagaggttttttttttaaactttttttattggttgcctcttgaagagttcaagatagactcaagttgtgtaaccagacatgagtagtaactcttaaatggttagtagagcatcttcaacatgagttagctagagtgtttttcaacatatgtatggattaacatcgaacatgggctagcactatgcttggtggttcttatgggaaagacaagtaaaagacatgctttttgccctttaggagcttactgcctggtttttaaataagtaccatgactaggtgcagtggctcacgcctgtagtcccagcactttgggaggctgaggtggaaggatcgattgagcccagtagtttgagaccagcctgggcaacatagcaagaccctgtctctgcaaaaaaaacaaaaataggcatagtggcatgtgcctgtaaccccagctacttgggaggctgaggcaggaggatcacttgagcacaggagttgaaggttgcagtgagctatgattgtaccactgcactccactgggccacagagcaaacctctgcctctaaaaaataaataaataaataaagtatgtactgtatgtagagatgtttattattaagcctaagtaccagaaatggggatgaagggaggaagcaccatttagaatgctgtgctatgtttcaagcaagtaacttctgagagaacatttgttgattgctagatttatctctgcagagcttggctttttaaaacaatgaaataatttagcagtttaaattctagggagtctttttctgtcttatgtgtaagttggaataacatgtagcaaaatactgtattttgtatgtgggagtccatttctgtaacatgtaaaacttcaatattcataagaaattttagaaaaatattttgatttttaaaatagattctaatacttgtaaaaagtttagggaaagaatctacttcatctagtattacctcagtgtggaagattcccaaatctatagtatatttctttgtgtgtgtgtgtctgacggagtcttgctctgtctcccaggctggagtacaatggcacgatctcagctcactgcaacctctgcctcctgggttcaagcgattctcctgcctcagcctcctgagtagctgggattacagttgtgtaccaccacacctggctaatttttgtatttttagtagagacaggttttcactatgttggccaggctggtctcaaacccctgacctcgggtgatggccacgcaccttggcctcccaaagttctgggattacaggtgtgagccactgtgcctgaccctgtagtatatttgtatgtcggtatatgatctcttgtcctttagctgtcttaggcttttataataccttaattttgcatgctgtatatgatttttaaatattattttaaagcattccttatttacagtttacaaagagcttttatctcatttaatttgcatactaaccttgggagataaattattatacttttataggtgaaaaaggtctagaaagtggtttttttttgtttgtttgttttttgagacagagtcttgctctgttgcccaggctggagtgcaatggcgcgatctcggctcactgcagcctccgcctcccgggtttaggcagttatctgcctcagcctccctagtagctgggattacaggtgcccgccagcatgtctggctaatttttgtatttttagtagagacggggtttcaccatcttggccaggctggtcttgaactcctgaccttgtgtgatccacccaccttggcctcccttacaggtgtgagccaccgtgcctggccgtgtttttgtttgtttgtttgtttttgagacggagtcttgctctattgcccaggctggagtgcagtggcaccatgttggctcactgcagcctctgcctcccgtgttcaagctattctcctgcctcaagcctcccgagtagctgggactacaggcactcaccaccacacctggctaattttttgtatttttagtagagatggggtttcactgtgttagccaggatggttgtgatcgcctgaccttgttattcgcctgcctcggccttccaaagtgctggcattacagacgtgagccaccgcacctggccaagagtgtgttatttttttaaaaggttaagtccaggttttttctttttttgtatggttgggagtgtttgtatctatattatttttattttattttattttgtttttttgagacagagtttctgtcgcccaggctggagtacagtggcacagtcttggctcactgcaacttctgcctcctggattcaagcgattcttgtgcctcagcctcccgagtagctgagatgacaggtgtgcaccaccgcacccagctaatttttgtatttttaatagagaagaggttttgccatattggccaagctggtcttgaactgctgtcctcaagtgatccatccacctcagcctcccaaagtgctgggattagaggtgtgagtcaccatgcccagcatcatattatttttaaataaaacaccatagaaaggaaagaagaatagaaaaataaattatctttagcccatttgtatgcagctgatgttaacatgttaatgtacttgttcttagtcttttcctatgcttagttttttaatagttaaaatcatactgcagacataattttgcattctgtttttttcgttggatcctaacctttttttttttttcccacttgaactcagatttttctgatggagtccagtggtcttttctctactccaatactgactctttataaccctcaggtacatacctgaatctgaacttctctcctgaatcagcttcttttccttatttcccactgactgtatcacccagtttgaaatttcagaatcatgttttgattctttgccatttttgcctagggcattagaatctcttctaagacttgtcaattcttgtcaccttttctcatcccttttcttttccaccgctatagttcaggtacttattattcgatgcgtggattattgcatggcgtcgagaatctccacctgtccagtttattttgtacagggccctcagatttatcttcctaaagccatgctttgattgtgctattcaccctctcagattgcttcattgctttaatgactacattcaaacatcttagcctcttaacatcttctcaagtcctctgtcatctctttctactgtcttaccatgttctgaccaaaatgacctatttcttattcctcacattttcatcttttcatcctgatgactattctcagtacccttcaaggctcaactcaaatattatttcctttctaaaaatgtttacttcttttcattcccagcccaaagtattcttccgtgaacacttgataggaccactcttggggtacttattgcagaatgtttattccaatagttataaggtgaaagtaattattacagatcttacaattgttatgtcttatttccctgagccaaattggttttatttttatttatttatttttttatgagacagagttttgctttgtcgcccaggctggagtgcagtggtatgatctcagctcactgcaacctctgcctcctgggttcaaggaattctcctgcctcagccttccgactaggtggtgttacaggtgtatgccaccacacccagctaatttttgtatttttagtagagacgggtttcaccatgttggccaggcctgtctcaaactcctgacctcaagtgatctgcccgctgaggcctcccagagtgctgggggattgcaggtaccatgcctaagccaaattataaacctcttgaaggctgtattgaaggttttattgaaggctgaaactctcatgtgtctttgaagtcttgcagtggagatttcatgatccagtaaaatgtggaggaaataaattagggactagtatatagttgacaacttaacaaccttcactttcatacctctttttttttttaaagaaatgacatttgaagaccaaaagattgtaatacacaatctcagaataaaaaattgtaaaattactttgaaaattaaatatggctcacgcctgtaatcccaacagtttgggaggctgaggcgggcggctcacttgagctcaggagtttgagaccagcctgggcaacatggtgagaacccgtctctaccaaaagtacaaaaaaattagccaggcatggtggtgcacgcctgtggtcccagatactcgagaggctgaggtgggaggattgctggagcctgggaggtggaggttgcagtgagcgcagatcacactactgggctccaacctgggtgacacagcgagaccccgtctcaaacaagcaaacagacaaacaaaaactcattatgttcttatttctcatttcacctgaaataagtgaaatgttctagactttattgggaatctgataaagaattctgtgccagattctagggtattttcaagtacaagtcatgtgcatgacctgttaatggtttttgaaatcagtttagtcgtggtcaggaccaacattagaaaaatgaggagaagaggaagagataatgtaaaatatcagtacttcgtgtgatattgcttcatggaacatttaatttcagttacatatatttgtcttagatttcagtgtaaaatttctgttggtcacaatcagatgaaagatacatttttagtggctaatccctatctttgagagaataggtggaaaggttgacatacatgaaaaggtggatgaacaatcagaagtaatcattgcgggctatgtctttgacaagtttttagaatctgaatataattagaatatgtttaacagcagcagcagcagaaagatatttattagttgtagaatcagtgtaattcaggcaaactcagtatgtaaagaagtgattttataaaattggtagggctagggtatgtttaccttgcaaatcaattctttactttgaaagagaattttcaggccaggtggtatagctcacacctataatcctagcactttgggaggccagggtaggaatatcacttgaggcctggagttcaagaccagtctgggcaacatagtgagaccctgtctctaccaaaaaaaaaaaacaaacaaaaattagctgaacgtggtggtgcatgcccagctccttgagaggctgaggtgagaggatcgcttgagcccaggaggtggaggctgcagtgagctatgatatgccactgcactccagcctgggcagcagagcgagcagcgagaccctgtctcaaataagaaagaggattttccttgtttgtagtgtggtgagtatcccccgtgtggtgcctgtcacgtgagagatccctgggagccaaaaacaacaactgcaaaaaagaggatttaccatattgctgtattttatttttaagctgatctgatggagttgtctgtgtcttgactggttccccacttatttgctgaaatacattttttccccaggaagctgtccctgattggtacactcaaaccattgcactatagcgcttctaaagtggagggggctgagcacttacacctaagggatctgggagtgtaggcaaaagttgaaatctatttaactttaaaatttatatgattgttttgcatccattataataaagatttgtttagacaggaatcatcaataggtgctaaatctagggggatattttggtgagaagcaggttgtctgcatggtcttaaatttccccccatataatgcttattacttgtaagggggggaaacagtaactcaatatggtggtgaaatcagacaacaccttgtgtgcatgatcaaaataaatatcaccaatggatttgtgtgtctctgcatgtgatacccagaaaagagcacatcagttacagtgtttttcagccatgaattcatagcctgaatctaatcatgaggaaattttaaactccagatggggaacatcctattttttaaaacgtcggggagctgggttttttttttttttttaatattataaagacaaagtctgtggaaacattccagactaaagaagacttaagagatgtggtaactaaatgaactacctgattttagactggatcttgtatagaggggaaaatacaataaaggatattattggatcacttggcaaaattggcatgtggatggtggtaagtattgcattaatgtttattgaacttggtaactgtcttcaggttatgtaagagaatatttttattcttaggaaatacatacccaagtttttatggagaatggtccatgatgtttatagcttatggtttaggaaacaaaggtaatacatatatgggggttttttgttttgttttgagatggggtctcgctctgtcgcccaggctggggtgcggtggcatgatcttggctcactgcaccctctgcctcccgggttcaagcgattatcctgcctcagcctcccgagtaactgggattacaggcacatgccaccatgcccggctagttttgtatttttagtagagatggagtttcactatgttggtcaggctgatctggaactcttgaccccaagtgatccacccacctagcctcccaaagtgctgggattacaggcatgagccaccacacccggccatatgtgttttatatatacacacagatacgtgtacatatagagggagggagggacagagcatgcatatgtgcatgtgtgtaaataaagccaacgggtaagatgttaataataggttaatttggtgaaagctatgtggatattcttggtactgtttttgttcttacagcttttctgtgagtttggaatcattttcaaatgaaaagtttaaaaaaattgtatgaactttgcattatacttcatagtatggcattaaaaaaaattggaactatcctgtcttccagaaaattccaggcaaacccttgagataaaactgcggctccaagaatatgttccgtgtatgtatcatgtggcttccttttatccctaagcctcagtttgagaaacatgtctctggaccagaggtagctgtggttcagatttagccaacagacatattttgtttggcccttttgagtgttttaaaaatagggagatttcacataacaatgtggatgtttggtttctattgaaaaatagggtgatcttgccactctggacttgcattccattccagatggtctgtatatgtgctaagtggtgtgccaggtgccctcagtccctaccttacatgcagcttgttttagtcatttctttcctggcctctatagacctgtctttgcaacctttacctagcccaagaggtgatgaaagtgcctgtcttctttacactataacaatttgagaattaaattgctaaatggatgccctatcaccctctaacattttagtgtttatttcctgtaagtaaggctttctcctacacaaccatattacaaccaacagaatcaggaaatgttgatacattactaattctcagacccattctagtttcactaattgtctcaataatgtcttttatagcaaaaagatctagttcacaattacatgttgaatttagttttcatgtctctttagtctctttgatatggaacagttccttagtcttccttgggttttgtcaccttgacactttggaaagttgccctccagttgttttgtagactgtccctaaatttgatgtttcatcctgattagattcaaattatgcaattttgggagaaatgccacagaagtgaagctgtgtttgtctcattgcatcctattaggtggcacacaatttttatttatcccattactgatgatgtccattctgatcacttggtgtctgctagacttgcccacaattttacaattttagtaattgcaaaattatttttcttgttttacttgttttagctggtagttgatagctattttgtaaaatgtgctttgaaactatgtaaatattcagttcttcatcagaccttcagtttattggtttatatctgtatggactcaggtttcttatttttttatttttattttattttgtatttgagacagggtctcactctattgcccagactggagtgcagtggtgcgatcacggctcaccgcatcctccacctcccggactcaagcgattctcctgcctcagcctcctgagtagctgggtttacaggcacacgccactaacacttggctaatttttgtatttttcgtagggatggggtttcaccatgttggcctggctggtctcaaactcctgacctcaaatgacctacctcagcctcccaaagtgctgggattacaggtgtgagccaccgcgcctggccaggtttcatatttttttgatgggttatagtccattactatttattttgatgcttaaattgaccctgttttggcaagtagatacccctctaaactgtcttctttgttcttttgccacgttctcatcattctttgaagactttcttgttttgtgacacaataagatgatccaggttcatcttgtgccctttttgctccagccctagaatcagccatttttgccaaggagccctagttcttttatggagaaaggtatttagaaaccaagctctatgtgctagttgtgttcagtgctgctggagtcctcgtcacagtagttaaaattaaggaatatatttatgtacatatgtgtgtggcaatatatagatatagttacagctatatttttacaacagcgtagggttaatttttgtttcctccttttacatatagttacttccccaacagaaacctggcttccattatgcttaatgtatttatttatttgatgagtcctcccctacataatcaatctcctgtctccactggtttcttttttttttttttttatgtagaaaaattcttcttttttttttttattatactttaagttttagggtacatgtgcacattgtgcaggttagttacatatgtatacatgtgccatgctggtgcgctgcacccactaactcgtcatctagcattaggtatatctcccagtgctatccctcccccctcccccctccactggtttctgcttccttgcttgttcaggttctgattgaacctgtgctgggctgccccctcatcttgtgccgacattctcatcccaccagggctccagcatcctatgccaggctgcctttctcatccacctggttgttgataccctgcactaaactgacaccccgtactgtgctgctcctctgccagaatgacctccttacacacttgccttgcactggctgccttgatagctttaggactgaactatgggggaaggggagacacctaatcatttttagagaaaacagtagctttaatgaaaaagtggaaaactatagcttttccaccaaatatcacaaatatttattttatatcacttcccaaatcttgtttacatgtctattggtctgctagagctaccatacaaaattaccacagactgggtggtttaaacaacataaacatattttctcacagttctggaagctagaggtcagaaatcaatgtttcatcaggtttgatttcttacaacaccttcctccctagcttgtaggttgccatcttctgtgtcctcatgtggccttttctttgtgtgtacatatcactggtgcctgtgtgtccagatttcctcttcttataaggataccagttgtattggatgaggcccccccacagcccactgcctgtctctaccaaaagtacaaaaaattagccaggcatggtggtgcactcctgtgataccaggtatcaggaggctgaggtggggagattgcttgagcctgggaggtggaggttgcagtgagctgagatcgcaccactgagctccaacctgggtgacggagtggtgactgaaactaattatagctcccagaatggaaatctaatgatttaacaaatatttattaagtaaatgctacatgccaggcattgttttcatactgggaatatgtcagtgaacaaaacaaaaatccctgctctcatgaagcttgtattatcatgaggggagatagacaataaagagttttaattaaattattcactgttaggaggtcagtggcttctgtgtaaacaattgatgtgtacattgtcggttttaagcacatgatccttttttcttagatggtggtgatacaacctgtgtgggatatggttatgtcagattatacagaaaagtaatcttggggatacaaaacaggtagttacaacattgatagctgtcctaggactactttgttatcatacatcttagtcactgtatctgattttgataggtttttggtatatgtatatgtatgtataaaatacacatatgctttttgcaggcttccattctcagttccttttttttaaatcgtttatatttaaggtataaatataatactgtgtatacaagtataaataatatactatgctacctttatggttggacatatatttttatttttagaatttttttcttattaaataatctggctgtatttcaataaaatcttttttttcaggttaattattataggtcactgtttatcaatctggattcaggacctacatccagtcactagagaattctcaggatgctggggaggtcttaaaacagctgtttgtgggtggttgtgttggtagaggcaaaatgtgggttgtaccaccaggatgaggtcacctctttgaccttctggccctctttctttccggactttaacacctactttggtacttaaagcaatttgggctatttgctgtgctctgaagtgttgtttagtagtagcacctataagatggtgttaaatgttttttgaatgagtctgtgtcacagcaacaaagaaagagttgttttcagtagtttgaaaaccattgatatggtttttatctcactctattcttacttaacctgtatatggccaccaggttattcattctaacacactgttttctttttttcattattattattatattttaagttttagggtacatgtgcacaacgtgcaggtttgttacatatgtatacatgtgccatgttggtgtgctgcacccattagctcgtcatttaacattaggtatatctcctaatgctatccctcccccctccccccaccccacaacaggccccggtgctaacacaccattttcattgtcactccctggtttaagaactttcatctcaagtttctatgagataaactctagtatggtgtccaagttgtcctgccacctggctctcacctacctttccagcttcaccccttactgcgccccctacatggattccctctgtatcccttttcttgcttagttttttgtgaactgctttcttcttataccgttatttattcaatatctctcctttctcttactaattcctgtttatccaaagtagtttaagtccatctcttcttttgaccactttaatccacagggattttctgtcctattttctgaaatctagcacatttgattttccttacagagatcaatcatatatttgccttatgttcttaagtcatatatagccctttaagtatttcatgtttatcttgtctcttcagttaggaaatacatttcttaaggacaagaatgtgccttatactaggttgaatgtattgccttttgagtggtaactgctctcatatccagtgcctaaccgctttggccgatgggaaaaccataggatcagtggattgataaaattctctttaactttttgtttttatgtaatctaattttctctcctttgtgcaatgatacatctgtgacatattggcaaaatcattggtcccggaataatataatacctgagcatatattgattttttttttcattttataaagaaactgagttgaagagagagaaagtaatttgctcgggattagaggttgacagactaccaccttctggccagcctggtctcttgttcgttctgtctgagaaaatggtttgtacatttttaagtagttgaaaaataaaaatattgtgacacgtgaaaattatatgaaattcagatttcaatatccataaataaaattgtattggaacacagccgtactcattgacttagggattgtctgtaactgctgtcacatgacactggcagcgtagagtagtagtaacagagaccaaatggcctgcagagcctaaaaatctctgctgtctggtttttcatagaaaaaagttttcaacccttgcttaaggttgaaacttgttcagccttgggttaaggttgagccatgatttacttctaggcagttagagagacttctttaactatactctcctgaacatagcatggggtcattggggaactgctaagtaaatattaataattgagtatggagatgagagatgaaggcaggagaggaccatattactgattatcttcagcgtcatgctgaagagtttggctttgggcctgaagctgttgggggaaaccactaaaggacatgtaatcaagtttggattttagaaagtttagtttgctcgtactggggagaatgaattggagcagacaatattgaaaataggaatatcagtgtggagtttttgcagtaatctaggagagacatgaagggcctgaaacaggtcttccctctggttttcttcagtagtgggataggagatacagacagatttaaaattagaggaaaaatctacaagactctgttatgaatcaggcactttatgcatatgagtttaagtgttcatagtaactctgaaaggtcattattttataataccaattaaaaaggccccaaaaaactgtaagtgggataactggagtttgatctttaaaaagtctatgcttttttactgaactttgctgtgtctgtttttacctgggaataatgctgcctacctactttggattgaatcagttttcctattttccaaatagcttataattgccacagaaaaatacatagccaaaataaggagatgccgaactacgttactatgcacttttatttccctgtattaagcacaggtttgttcgttctggatccacaatgaatttgatttttgactttttgaaagtctttatacttgaaaaaaaaaaactttttactgtaaggtaaatatttttaatgcctttaacttgacaaacttgctgtataccctagggtagattatggaatttgaaaaacaacagataagataaagacacattcctaagaaatgtatgagaaagtgtttttagagcaagcttttgagaatcattttcttttctttgcttattaatctcttcctacctcacatcactgacattttgttttaaccctggataaggcagttagctatttgtgtcagacttcattggacttatttaaaactgggtatactctgctcctttggggatttgtctggcattttcattatcaaatgcattctcgatagcaaattctcacagtcctttgttttaaaacaacattagagcatttcatatcttggttttagtgaaagagtagaactacagagtagttttcagacttcaaaatttttaaatcagctttattgagctgtcctttacatataataaaatgacaattttaggagtacaatgggtctttaaaaaatttatatcattgtgtattcactactacaatgaagatacagaacattttcattaccaaaaaaattctctcatgcctctttgtagtcagccccttccctctacatagactccagttcttggcaactgctgatctgcttttttccattgtattttgtcttttttttcttctcctttttttggagcgggggggtgggggggacagggtcttgctctgttgcccaggctggagtgcagtggcaggatctcattttactgtaacgtccaattcctgggctcaagtaatcctctcacttcagcctcccaagtagctgggactataggcacacaccaccgtgcccggctaatttttttttttaattttttgtagaaatggggttttgccatgttgcccaggctggtcttgaactctgggctcaagtgatctgcctgcttcagcttcccaaagttctgggattacaggggtaagccaccacatccagcgtattttgtcttttctagaatttcacatgactgggatcttataatctgtggtcttttttgtgctttttacgtagcatattgctttagagattcatccatgttgtttgtttcactagttcgttccttttcattgctgagtaatatttctttgtatgaatataccacacttagtttattgactagatgatggacatttcagttgctattagttttggctgttacgaataaagctgcagtgaacatttgagtatacatcttctttcaggccctagcaaccatgaatctgttttctttctctatgaattctcctatttggtgctcattttttttaaaaaaaaatggttgccttaagttttgagagtattttatatgctttgggtacaagtcctttataaaaaatgtggtttgcaaatattttctcccagtctgtggcttgccctttcataaactaacagtctttagaagagtgaaagttttttagtttgatgaaatccatttatcagtttattttgatgttcaacttatttttttcttttgtagtttatactttttgtgtcctacttaaggaatttttgcctaacccagggtcacaaagattcttattatttcttagtttttgctcttatttttaggtcgatgatctctttagagttaatttttgtatagggtacaaagtcaagtttcgtttatttgcacactgatgatttttgttccagcacaattgaactaatcggaaagattagcctttttccattgaattaccttggcacctttgctgaaaatcaacagaccacatatgtgtagatggagttctgcactctgtattctgttatgtcagtctctgtttgtcactaagcaaataccaccttgtcttaattactatagctgatagtaaaggtttcaattaaaatttttatatatttgaaaaataatgtagaggaaatggaaaataatgtagaggacctcctgggctcaggtgatcctcccactcacctcgcggagtagctgggactacaggtgcacaccaccatgcctggctaatttttgtatttttttgttgagaagggtttttgccatgttgcccaggctggtctcaaactcctgggctgaagtgatccgccagtctcagcctctcaaagtgctgggattacaggccgtgaaccactgctcctgggtacttatattttagggtttacttttaaaattactttttttttgagacagagtcttgctttgtcacccaggctggagtgcagtggtgcgatcttggctcactgcagcctctgcctcctgtgttagcctcccgagtagcagggattacaggcacctgcaccatgcctggctaatttttgtgtttttagtagagatggagtttcaccatgttggccaggttggtcttgaactactgacctcaggtgatctgcccaccttggcttcccatagggctgggattacaggtgtgaaccgccatgcccagcctacttttaaaattactttcaagggccaagcatggtggcttacacctgtaatcccagcgctttgggagtccaaggcaggaggatcgcttgagcccaggtaggcagcattattcccaggtaaaaatagacatagcaaaatcagtaaaaagagcatggactttttaaagttccaactccagttatcccacttacagcttttctgagcctttttgtttaagttttttaagagatgggatttcactttgttgcctaggctggtctcaaattcctgggctcaagcagtcctccctactcggcctcccaaagtgctgggattacaggcatgagccaccatgacgaaccacgagccttatttttaaaacagtgataatatttcagagttactgtggggagcacctgaaattatattcatgaagtgcctgatttataagagagtcttgctgatttttcctctttaattttaaatctgtccatgtctcctatcccactaccaagggaagagaggaggagacctgtttcaggcctttatcatgtctctcctagattgagttcaagaccagcctgggctacatagcaagaccatgtctctactagagagaaaataagtgagccaggcgtggtagtgcatatctgcagtccctgttacttgggaggccaagacgagaggattgcatgagaccaggagttcaaggtggcaatgagctgtgatcttgctactgcactccaggttctgtgacagggcgagaacctgtctcaaataaatgataataaaattactttcaaaaacatgatctccttaattcactaacaatcttaggaattagaacagacattaatatctgtattttataaaagaggaaactataaggtttaagagggctggtttgatatcatacagttagtgtgataaagcactgaagcccaagtcatgcctttcaaaatacggtgctttccactatacgatacttttttcatttgctgttgttctcttatgttgaatactgaagaaagagtgttttatgaataattcaatcacaaaattttatttaattatatagctatatgaagacagctaatccatttccttggttactaacatcatgagacatattacgaagtcaaaattcccaatctgaaatgcaaagaggaaaaaaaaagtcatcaaaattgggctctttttttttttaggtgatggtgttttacaaccagaagaggtgcttataatttgattttaaatttagaaatgcagggaagaggcaagatttgttaaaagaaagcagaaatattccttgagaaaattattttaagaattaaagatgttcttgtcaggatgatagaacttaagctttagactatttgagtgtgtatgtgttatctatattctcttttgttgccagactttctattctttgcaaccttaagtctcttccctcccattccctcctcctgctgagtccccccacaatgtcaggtcatagttaggaggttcttgcaggagtagtgatgaaagataatggtgactagagtttgagtagtgatggcaaaagaaacggtagggtttgggatatattttgaggggcctatggatgtgcttgatgaatggatgtaagggacgaagaaaaccaatgaatcacagataactcctagtttttcagcttgatcaacttggtagtactatttagtgatgtggggaagacttagatgaattagatgagctatacagtgaatgatgggaaatcagatagaagctatttttttaagttttgttttcataaaaagtaatatcacatctcagacattggaaaggtagagactagatgaaattacttatgatcctgacttcctgacacaataattttaagtgttttggtgtgtatctttatagtcttgcataggggttggcaactttctgtaaaggcagcttcttaactctgttgtagcatgaaagcagccataaacaatatgtaaacaaatgagcctgcttgtgttccagtgaagctttatttatggacactgaaatttgaacttaaggtaactttcacatattgcaaaaaattcttttactcatttttttccccaaacattgaaaaatgcaaaaaccattctttgtgtgcaggccacacaaaaacagttgacaggccagatttggctgtgtagccagtttgcaggcccctggtcttgtgcatttgttttatggttatagtcatatcttacattgaattttattacctaccttttctactttatatatgtgcatactttttaaattgaaagacaaagtgattgcattcgttgaatagtaagccctgataaacttagtttacaaagtgcctttatgttcattattttttttaattcttagaataaccatgggaagtgtgtgtcatgcttaatataaagtaaaatatgtattatgtacataattgagggtaagttatacattatcattagaactctgtctcttccatttctctctatatgttggctttattctctgaaatgatcttcccccagcagcagtggtcatggctaccggtagctctggaacaacatcctcaaagtttccctccctcaacactagtttgagaaattctaaggcaggactttggtcctgttacatcaaaatttcatccccctgttaatcattatgtgttgaaagggcagggtcatgtaggaagataagagttctcatttagaaccaatgtttagaaaaataggagggagagtggatagtttctcaaatgaaggatagggtagtgcagacatggccacctgggggaattatgaattagccaccccaaattgtgtctgttgacattgtttaatattgatttaaaattatttaattttatgctcttttcatttacctatttgtattatgctcagttctctttgccgttgccactttatgttttatcaccacctcaaactgaattttaaaaatccctagttttgccgggcgtggtggctcacgcctataatcccaacactttgggaggctgaggcgggcggatcacctgaggtcaataagaaacctggccgggcacggtggctcacacctgtaatcccagctctttgggaggctgaggtaggtcatttgaggtcaggagtttgagaccagccaggccaacacggtgaaactccatccctactaaaaatacaaaattaaccaggcatggtggcacatgcctgtaattccagctactcgggaggctgaggcaggagaaacatttgaacctgggaggcgaggttgcagtgatccgagatcaggccattgcaataagagggaaactgtctcaaaaaaaaaaaaaatccctagttttgaatgtaatttccccaagagtctgggtcttatacctcagtgaaagttactcttttctttgctggtttttttttgttgtttttttgtttttttttttgggggggggaggtgtagtcttgctcctctgttgcccgtgctggagtacagtggcacaatcttggtgcttaactgcaacctctgcctgctggcttcaagagattctcccgcctcagcctcctgagtaggtgggattgcaggcacccaccaccatgcctgggtaatttttatatttttagtaaaggcagggtttcaccacgttggccggactggtcttaaactcctgacctcaagtgatccacctgcctcagcctcccaaagtactgggattacaggcatcagccaccgtgcccagcctactgttttctttttaaaagaccatattctgaccactccagtccctcaaatactagagtccttttatgaaaaaaatcttggtcatctcttgcctctttgattgcaatatgaagagttagatgagaaataggtgagcatcatttgtaaaccccagacattaaagcatgaaggattttgctagaataactggctcccactaggattcaaaaacccagaaaaacagtgataaatgaagcagttgctcttctctgagtcttcagagcaactgattccagtatcatgattttcacttttctgtggtccttatctagagaccctgagattcttggtgcatctgcagaaagcatttagggttttgctaatctggaggagtgattggtgaaactcaacagtcatgaaactgctttgcagactctgaggtagtatagtgtatgtcagggaggtggtggaaactgacatgtttggctggttggctccacttagccaaaccttagtctttagctgcagtacaatatgtttcatagtaaagaacagtcatataccacatatgagggtatttccataagattttaatactgtattttactgtaccttttctgtgcttacataccattgtgttaccattgcctacagtattcagtgcagtagtattctgtacaagtttatagcctaggagcaataggttataccgtatagcctaggtctgtagtaggctataccatctaggtttgtgtaagtacattctgtgattttgcacaatgaaattgcctgtgatgcatttctcagaactgacacatgtctgtactgcaaaacgtgcatgcagtttattctgctgaaggaaaaattagtagaagctggtttttagatgaacgataaaaagagtaaaagcatttagaatggtgtctgctgtgtgattgtttagactgacagtggaaaatttcttagcaaagaagttgctgttgcaattttatttcttagggccaaacccaatctgatgctataatgagaactaaaatgatttaaattcctttaagttttgacctttttcattgctgagatttcttaaagggacattgttgatatattttgcttttaagttttcacttttgtcatctatctattgagtcattataggcgttcttttttttttttccttttcttaatgaagtggggtcttggtatgtcacctaggctgttgtgcagcagcacaatcatggctcactgcagccttgacctcctgggctcaagcagtcttcctgcttcagactcctgggtagctgggactacaggcatgcaccaccatacccagctagtatctttatgttttgtagagacaggatctcactatgttgcctgtactgtctggaactcctgggctcaagtgatcctctccctttggcctcccagagtgctgggattacaggcctgaaacactgtgcctgacctgcagtcttattttaaactgtgttaacattactttattgtgaaatagttgcagaatttcccttttaccatttttagggtaattcatgtttgctcattttaaattttattaatcattgtttttatagcctatataaatatacacaaaaagatagtcatcataaatttttaatgtgtaatgttaatggcttatttgaaatgggatatcctgtggtgtttggttaaggaaatcaagtccttttaaataagattaggcaaagtatatttgtatatttttcaattattttctttatatttcttttcttttttttgtatctagtcctgaatcctaatccagatctgtatttttcacttctctctctctcttttttttttttttgcactggataatttatatcattgttgacttgtactatggaaacaaattttttgtcagaaaatattttgtgaatattttcccctacattgtggcttgcctggttacttttttagtgatatcttttgattgagtaggactttttaatttaccttttttatttcttttttttttttagacaaggtcttgccctgttgcccaggctggagtgcagtagctcatgtgatgcccaacctccacctcttgggctcaagcgatcctctcacctcagcctcccaagtagctgggactactgatgtgtaccaccatgtctagcttatttttgtattttttgtagagacggtatttttaccatgttgcccagtctggtctcgaactcctgggctcgagtgatccacttgtctcagctcctaaagtgctgggattacaggagtgagccactgcttggccaggatctttaatcttgatggtctgatttatcatttgttccttagggctttggcttttaggtctatgttctaccttagattaatttctgtgtatggtgtaagataagagttaaaagttaatttttttcttacaaatatgcttataaatgctaacaaacaacattgtttggcaaagactttgctttatttccaaatcaggtaatcagtattatattataaaattattagttatttcaaagtagttgcatggttagctagttcattgattatagaagctgtatttttttaggtcagaattatgggtttataccttcgggatccagttaacttggccttgttttgtggccatggaatgtatttctcctaagttgttttagtcatttgttagatttgtttcattgcaagtaagagggtatatgataacttcatcatgctaccagataaaacattagagcatatgccttacacgactattaactaattttattttgtgtgagagagattacattattacattttaaggatacggtattcatagtattataatgtttaatgtatcatactcagtttttatgccatactaaaataagcaaaaataaattgattttagtaaacattagaaataatttttcagagttttgtatagagtgggaaatgtagatctgacactgtgaaatccgtttgttaggttttgtgggtaaataatgctaagtataaaaatacaagacatagaaaaatttaaaatgtacgtttgcatatgcttgtgccaatatatagaccattccataaacccaatcattggcttacatttctgagataccagcattaaacatgagttatcttttaagaggctgaatttgaattatattactctgttaggatttgtgccagcttttggttaatcattatcttgttgattatatttggttcaagatgactcatttttcaaggagctttattgcaacactacatatttactacaggaagcctggatggaaatggagcatcaggttattggagatttttttctccaatctttattgtaccaagtgttattaaagttaattatttttcaataactgaattccctgtggaacctagtgcttcattaaccaactgtaggaggatcatttactcctttttcatggcagacaaatatatctttgatgattgtttaaatattggtcatacttctatactatacattgaccagacttagatatagtattttattctcatcaaattgagtatggtcattaactgagaattttggaatcagagagatttgagattgaaccttgtttgtaaaatttactagctttggaagcttgtgcaaatacttctctgaaccctagcgttcattcagtcattaatgagtgaattaatacattcagtcattaatgagtgaattaatacattcatttattaatgaatttggataaaaatatttaccttgcaagatcagattaaaaggacatataaaagtattagcacttaatatgtgcttaatgatgatcaccatctgttgacgcttgcttatggtatatattgaggttaggagtgccaatcatttagcccttctgtctccaggttctaagagataaataatggacacagcatctgtttctaaaatttagactgtctgataacagcagaatttgagaccataacatggatctaaggataaattgagagtcagctgcaatcaccaacaaatctagactgtgagactatgataagagttccgtctgccatgtctgctctgactacacttaatctggcagctggcgagaagattagaggcttactttatgtatctagttatcagcgaaacaaagagctggagtgagaaagggaaagatggccttgttttctatgcagtaacgtaatttccttcttgttaaaaataaggtccaaggaaagctaaatctaacccaccaaattagtaacttcccttccccctctgcccatgcaggagtttgtggcttgagtttgtggaagagagactgggagagttttctgtaatacctaatacagtaaccaccctgcctccaccctgccctctactgtgggaaagagaagggaagtctcattctttataatgggagattagtgtaagagtgccccctactttgaaaaagtaaatttcacttatgttcagtgtttttgtaggcccatagaataaatacagtagaagagccctgcagaaatgaaaagccatgctaggaatcaaagtaaatgttggtttaaggaagtaaattgtgtctttatttattttttgagacagggtcgcactctgtcacccaggctgaagtgcagtggtgcgatcactgcagccttgacctcccaggatcaggtgatacccccatctcagattcccgagtggctggcaccacaggcacgcaccaccactcctggctaattttcgtattgttttgtagagatggggttttgccatattcccaggctggtctccaactgtgagggctcaagtgatccgcttgcctcagcctcccaaaatactgggtttacacgcatgagccaccacgccccatcttttaaacttgttaatagaaaaattgatgttggtaaagaaaaagaaccccccaaaaagatagatataggcaataaaaatcacaagtcatctattggcaggaggtgataagagttctgtttgcaaagatatatttaagacacctgcttaaatactagattttttttaaatgaaaatatcagtaaatccaaaacaatagtcttcagaaaaaaaaaacaaaatggtgtaaactcaacataaattgtgaatctgttctacaaatgagtaattttaaatatctgtgaaatatatattggtagtgaatattttatcttaaaaagcaaaaatttgagaatgatcatttattggcacttcagaagaaaccagtaaacgtgtagcaaaatagtgaataaatgtcagttaagccagtaagtgtgtcattagctattgacaaagattacagttttggaaataactccagatgtgctccacctcaaaccttgtgtactcctttagccaggatttataaaatagaattagaagcataatatatatgtttgtaatttgaagcatagggtggtggttaagaatctgggctccagagtcacagtgcctacgtgtacatcctggcacctgcaattactagtttgtagccttggacaagttatttaatctttctgtgtgccccatttgtaaagtggtactaatacaagtacctagttgatagggttgcttatcagtgactttactggaattacagagaccagtttgctacaggttaggtagtaatggaaaaagagaatgtccaaacacctgtagcttgctcctaccagaacttcttaagggagatagagggagtctgacttaaaattgaattttttttttcttttttggttggtagagatgtgaatatatatttatcctgagggaaaatgaccagtggatagatcagatgtgagagagaatgggcatgtatgattgacctaatgtctctaaagaaagtaataggggagacactctaaagcactgggggaaggcttggtgtttaactcaagaggcacctgttttaatgagttgggaggggctgggtgtggtggctaacacctgtaatcccagcactttgggaggccaaggtgggaggattgcttgagaccaggagttcaagcctggtcttatgggcaacatagtgagacttccatctctacaaaaaaagaagaaaaattttaaaaggaaaaggtggtaaggatgctaatttggggaggaatatttctacctgaagtctgctattttctctttgaaagaggaagtgaggacacattctgagaagtatgaggtggaggtggtggaattgaaagctggaagagagttgtgaggatttggaatagttattgaggcaatgggagttggagttcacttggaaaatgtagagagaccaagatgggtttgatgaccatgggtttttgtggtggtttctgttgtgtgtatgtattctcattccttccctgtgtctctctctgcagtacccagcagccattgtgtagaaacagaaaagctgggcagtcaaaatgttctggtattggtggaggcaggacttgacaaaggagagtggtttgggaagacccaggggccaaaagttgaaagtattgcagtgagagtggttgaagttatgtatcttgggggtttaggctggagagggaacaccttgaagccaagacaaggttgataggtggggagaaagtggaagaacattaacaccaaaagtttccatgaagctaaagggtgaagtgtgatggggaataggagtgaaagagacaaaggataagggcttggggttatgggccaagataatgagttttaagatttcagatgagtaattgttgtgggtaataaagcgagtggttatagaggtggattattcaattgggtagtggctatctcttcactccttaaggaggagagcagctaggatgttcacgtggattggaatttgcccaggctaatggtggctgaaaaggtaaattagatagtaagatcaaaacttatatgtaatttggagagtgactgagaagttgattgatgataatgatgaataattaggttagttgttagatcctagttataagtaaaggaggaaggttttgcaggagacttttggagtaatcatatgtgtgctgcaatagaaagaagacaggacaatgctgttatctccctgttttctgttgagaggtataagagaaagaatagttgccgttttgactcagctggaatggaagtggtgtcgtgtggaaaagttggtttcaattagaggcaaaaggtagactgaggttctgtaaaggatctagagaagtttatttgaaaataagaagcattgcaaatggcagtagtgaaaaaggttggaaaagagggtaaccttttgggagagtgagcgggtaagcaagagaaggaaccgaagcgtcacagaaatccgaggccataagttactagtcagatggtaaatgtatcagggaagtgaaagtcatctatgggttattgtggaatcatggaaagagaccatttgctttaaaggataagtatatggggtatcatttatgccagtcttaaaaaacaattttgacattggatcattccttaatgagatgaacagtggccgggtaaataaggttgctgagatttagaatagaaataccggccaggcgcggtggctgacgcttgtaatcccagcactttgggaggccaaggcgggcagatcgcgaagtcaggagattgagaccatcctggctaacatggtgaaaccccatctctactaaaaatacaaaaaaaaaaaaaaaaaaaaaattagctggacatggtggtgggcacctgtagtcccagctactcgggaggctgaggcaggagaatggtgtgaacccgggaggcggagcttgcagtgagccgagattgggccactgcactccagcctgggcgacagaacaagactacgcctcaaaaaaagaggaatatcagcactgtgtagacaaggggaaaaagaaagaatttcaacaaaaattatggcctttgctccacatgtgacctgtaagctgtagagagcagtcttttttgaatttggcataaatgcttttatggacaaatgttaatttgaggttgttaggtattgtggttgtcaggcatatttaattcaacaaatgctgatttcttatttgctggtcattgagatcaaaagctctctttttggcttgaactccctttctccagttgaaaagatggtttcagaaattctggcactaattcagacttacagactttctttgtagagacagtaatcctcaagttcagcagtttgactctaaatatcataacaattctaaattcatatctagaggaatgttttatatcttttttggcatttttaaagagtttttgcagacactcatagtcttggcatgccttctattgaatctttggtgggagaaagaatgtaaagcaaaggactgaaatttccagcgctttgcaggggacagtaggggaaatgaggcaggaaatgagggcccacttagaatgcagtttattccaagtcttttccacttcccctgttctccatgggctgcctgctgtattctcctaaggatgaccctaagaaattaagtgaattgcatcctctaattgttgtctatagcagtaatatgacagaagtatagtacttttaagttcttttaagtgaaggatacctgtattctaatttccatcaatcaagtcgaatttctgaagattttgtcaactgtgctaattttcaaaatgtttttgttggctacatgctagctggaaattaactctgaaagcattaccatcaaaatctagctattaagtaaatatataaaactaatttatcaggcatcactctgtatcagaatctgtttgatgtactttatgtgtattggctcatttaatcctcatagtaagctgtgaaggagttagcattattatccccattttacagaggtggaaactaagggatgagttaattaacttgcccaagagcgcacagctaggcttaatgtatgcagatttttagcttgatttaggaagttgaacataagtctaatagaactttaaaaagttaaaagtataacgctttctgtgatgaagcagtcccacttctgagtatatatccaaaggaattgaaaccattatattgaagagatgcctgcactctcatgttcattggagcatttttcacaatagcaaggatatggaaaccatggaagtgcccatcagtagatgaacagataagaaaaacgtactcagccttggaaagggggaaagcctgtcatttgcacaacatggatgaacctagaagacattctgctaagtggaataagccaggcacacagagacacatacccagataacacatgatttcacttatatgtggaaactgaaaaaaagtcaaactcagaaaataggccgggcatggtggctcaggcctgtaatcccagcactttaggaggctgaggtaggcagatcacttgaggccaggagttcaagaccagcctggccaacatggtgaaaccccatctctactaaaaatacaaaaaattagccgggtgtggtgctgcgcacctgtaatcccagctcctcaggaggctgaggcaggagactcgcttgaactcggggggcagaggttgcagtgagctgagattgcaccactgcactccagcctgggtgacagagtgagactctgtctcaaaaaaaaaaaaaagaagtagaaagtagaatgacagttgccgggggcttggaggggtgtagacagggaaaggagaggcgttggtcaaatagtacaaagtttcatttggacaagagaaatagatcctggtgatctattgcacagtatgatgtctgtagttagtaataaggtattgtaggccaggtgcagtggctcacacctataatctcagtgctttgggaggccaaggtagaaggattgcttgtggccagtagttcgagactagcctggtgtattagtcagtgttctctagatagaaggattgcttgtggccagtagttcgagactagcctggtgtattagtcagtgttctctagagggacagaagtaacaggatacatgtatatataaaagggagtttattaaggaatattgactcacatgatcacaaagtgaggtttcacaataggccatctccacactgaggagcaaggaagccagtctgagtcccaaagctgaagaacttggagtctgatgtttgagggcaggaaccatccagcacaggagaaagatggaggccagaagactacatcagtctagtctttccatgttcttttgtctgcttttattctggctgtgctggcagctgattagattgtgcccaccccgattgagggtaggtctgcctttcccaatccattgactcaaatgttaatctcctttggcaacacccttcaatccaatcaagttgacactcagcattaaccatcacacctgggcaacgtagcaagaccccatctctacaaaaaataaaaaaattagcctggtggggtggtgtatgcctgtagtcctagttgcttaggaggctaagacctgaggattccttgagcccagaagtttgaggctgcattgagccatgattgtaccagtgtactccagcctgggtgacaagagtgggaccctaactctaataataataagaagaagaatatattacatatttcaaaatagaatagaatagtggattttaaatgttctcaccataaagaagtaagtatttgaggtttggtggatatgttagttggcctgatttggccactctataacgtatgcatatattgaaacatcacattgtgtcccataagtacatataattattatttaccagttaaaagaaaacttaacctaacattttccatgagtatatgaaggtaagtttggttttttcccctcatggtccagtagacgtagtttatctttccatctgtggtagcccttttttgtttatcagaggatctgaaataaaaacgttttgaatccatgttgaatactctatgatagagtttttctgaacttgaataaatttggtttgtcatttttaagcaaagtatattgacatagctgtaattaaacttattaatataacaaagttcacatgaactttatatagattttatttgtagtacagtggacggcatcattacctatggaagcagttatacaagatggctagtctggaatcacagattaatactaacagccgtttatatacttattttttcagactttatagccaccccttttttttttttgtagaagttccctccccccacatattttggtgtgaattgcagttgcctgaacataaagaggggaaaaaaaaaacagagaggattaattgataatatacttctatgccacatgtataggcacaaaaaggcctggacctcaacagtttgatagggaaagagtcccctgtaactatagtaactatagtggtaataataatgaaaatatagtgcttactataaggtatagtgctaagcactctgtatttactcctttatacgatactgttacctttctttttcccccaaagagatggagtctcgcccttttgcccaggctagggtgcagtgacacaatcatagtgcactgcaccttgaactcctgggttcaagggatcctcccacctcagccctccgaatagctaggactacagccatatgccactaccccgggctaatttttaaattttttaatagagatgggtctcactttgttgcccaggctggtctcaaactcctgggctcaagtgatcctcctgccttggcctcccaaagtgctgtaattacaggtataagccaccatacctggcctatctttctttaaaaaaaattagaagttttagttttagaaccattagatgactttcgacaagctatataagcagttagtggcaaagacaggttttgaacccaggttggtctgatttcagtacctacagcttaatctcttgtctgctgtggtttatggcaggggctggcaaactttttctggaaagggccagataataaatattttaggctttgtgggccacacatctccagtgggactattcctctctgctgtttttgtaaaatagccattgacagtacccaaaagaatgtgccggggctatgttctaacaaaattttatttatcaacactgaatttcatgtaatgtttatgtgtctcgaatagctgttgttccttgaatttgtttttcagctatttaaaaatgtaaaaaatcattcttagttctcttaccatacaactaagggatggtgatgggatcagatttggcttgtgggcggtagtgtgccaacaactactgaatggcttgctgtatttgttttttctccctactaggataaacagaaatggatgattcttctaacagtttttcagaataatgagaaactgttacagctagagttagacctagttaactagttaacctagttaggtaggtagagttacaagctagtaatgaatctgtgtaaatgttctttgcctcagatattcatgaatgctaagattatggggtccctttaatattacagttcttcctattactataccatatggttttagaaatcataaatattcatctcttaatcatttgcaatacattgccattttgttctataatcatccaaagaactttgattcgaggtctttttgtatattaggtgttgaggtaatttgattcttttattaagagaaaaatttattggaaataaaatgaagggttctcaacaaagatgattcatgcagtctttacaaagtttgcctcttagattacaatttgacatttataaacttgaccttgtagaattttagtataagttggcttatgtgcaacaaaaaacacttccagatgtgatcactgatacaattctgaattaaaatgcttaatgaaaacttctagtgttgacagatcaacactaatcaaataatctgtccttacacatagtgaagtttatcagcaaaagttgacatttttatatttggtagggaaaagagatatactctaaaagtaaactaatttcagcttgcccaataataataataataggtgtagatggtgttgaattaaatgcccctgccctcagtcagcttccctggcttacctaactcacagtaagcactcaataaatgtttgctcttagaagctgtgtggtgtggcctgaatcagtaggcacttaaatgaaggaagtggaagatctgttagtgcaaaaagaaagggtttttgttgttgttgttgtttgtttaaggaagtatcaacttagaatttagacagaaatggataaattgtttgttacagtaatactatgtcagaattatttagtggttggctatagcttatggtatgaaatcctattttctttgggttagaattccctaatttggccccagccttcctttctagtcttatttttactctcctgtgttaacagactatgtagtcagtttccattactcagtcatttatccacaaatattctgccactttggaattttcttctttctctcctctacctagcctgtttctgcttagatttcaagacccaattttttttctttccctaggaccactcttgctaatcatgatcatttttgcctctgaatttctagcacttactgcatttatcactcatttgacaattactcttgttctgctttgtgacatttcttataaaagtaagtaaacgtttgtacgacatttttaaatctgtagaccttattcaagtttcacaaatttgttccatatagcattccccccctctggtccaatccagaatcaggcattacatttagtttttaattttaattaatatattttttagagacagggtctcactctgtcacctaggatggagtgcagtggcataattgtagcttagtatagcctcacattcctgggctcaagtgatcctcccacctcagcctcctaagtagctgggcctataagtgtactccactgtatccagctgaattttgaatttctgggggagaaatgggatttcactgtcttgcccaggcaggtcccaaactcctggcctcaagagtcctcctgccatgacctcccaaagtgttgggattatagacgtgggcactgcacccagcctgcatttagtttttatgcctagttttatgtctagtcgtcttgcctactttaatctggaactgaactgttcgtgagccttttttgttccttttatgacatagacagttttgaagattactagccatttattttgtaggctgtctctcaatttagttttgtctgatatttcttcatgatcagatttaggatatgcatttttggcacgtataatacataagtgatgtgttctcagtgcatcatgtatattatttttggtaaatagtaaaatttaaatcatcacagtgaattacaataattgctggttggtttgaataacacagtaatcaagacagtcctggattcaaattctgaccttaccatttgttgatcatgtaatcttgggtgttacctctctttagctaatttctacatctgtaattgtagataatttaaataccttttggttggtcaaaaatagttgcatattggcagttttatagggatctatttaatatttatagatttgtgagatgaaatgagacaatgcagctgtcactgaatatgtgttcagtacactgtagtaatagattacttttcaatatagttctgtagaaatatgtcagcgtgattattggttacattctaaaagttatttttaagttggatgtataacacctcctctatttgatattatcagttatcatttgtagttttataaaagtaatttttaaatacaaccaaaacttttataaatgtatatcttttactaaaatatatctatgtatacacatacaacctccaaatatatattaatataatactagatataactagttttcacataagtaatttaaagaatgtaactagtaccttaagggtgattggagtgtcttagggttgtttgcctctgcactgtatgacctaggaccttataccttttcacttattggtatctttttaaaaatatgattttctcattgatggatgagttgtcagtttcttgcttacgttagcagctctacctgaaccactttttaatttgttgctttttatttgctgtgaattggaaagccagatttttttggttcctacccagttctaataaatttagttaacaggcaacttatgagggccagaggagctttcctgaacgtaagtggtctttatacttatggttttagtttggattgttttggggtctttttctgcttactttctggtcttcactcagttctgattggttgaagttgaaaaataagtgacttgtctctgagtttggcataatataaaatgcaaatttataatattaaatgcgaattcacctttgcttcactgatgaataattgatttcctaattgttctgtgttttagacaatcatatttgagctatagttacattatcttatttataggaagtttttccttaaatgttgcagtgaagattggtaattgagagtcctgaaaatggcagtatttggatatgagtatgctacagtattgacactttctgaaagtcggacatcagtatgcgagagcgtacttcgtgatagcagctcacactttcaatttcacctcttctttggtggacaggtacaaattacatttgtttactaccttttcaactcatgtttctgcatttattcgtttattcttcctggccactctgggagggaggtcttatgtcttctgaataaaggacagtggccataaggtgagtaaatgcagagtgagtattcagattttgagataaattttcattctcaaacctactttgaatctgagtaattttgccttacatcatttagaaccagatttttttaaagttctgattttgtatatataatcaaagaactaaaatttatattaaaaaatttttattttatgttaaatgttttctttacaatagatttattttagaaacctactcctttaattttttttcttttcttttcttttttttttttgagacagaatctctgtcgcccaggctggagtgcagtggtgcaatctcggctgattgcaacctccgccctctgagttcaagctattctcctgcctcagcctccaagtagctgagattacaggcacctgccaccgcacccggctaattttttatgtttttagtagagacggggtttcaccatcttggccaggctggtcttgaactcctgacctcatgatccaccctccttggcctcccaaagtgctgggattacaggcatgagccactgcacctggcctggaagcctactccttttatttatttttttacttttttgagacagggtctcgttctgtctggcttttttttttttcagacacagaaagccacatagaacaaatttaaagcttggtaaattattatgaaatggacatccttgtaaccacagtctagaacaagaaatagaagttagtcacttcagaagtccctataggtacccatcccatttacagtctctttcctcccaaattgtctactcctagcttttgtagtaatcacttcctatttccttatggttttatcccctaagagtccatcgctagacactagagtttagtcttccctttttaaaataaagtatttaaactgcatctttataatctaattgtaaaggaatgagaaattacagtgtattaaaaaatcactaatatgatactaaaagcagttatttggaaactcaaggccctatatagctaaaaacatggtttcaaaacatgaaataatttttagacaattatgttaacttttctggtttttttccttttatacaaataccacaaagcagaagtgtactttaactttctttcaatacccatcttttttccaagataatatgttgtatttctttttatgtcggttatcatttgtgaagggctttttcagtttctaaaacagatattcatgatctgatttaatcctcacagcagtcttgtaggcatattcttctttccattttatagatgaggaaatgataatgtaactagtaggtggtgaaactttgatcggacctttgattaaaaaggatttcctcataaatgtttttcaaactttagttatctgagtactgccttcatgattttcccagtctcttaaaactattactattttacttaataattttatttaaaatgacttttaaaaaactgataagattggccagacacggtggctcacgcctgcaatcccagcactttgggaggctgaggcctgtggatcacctgaggtcaggagttcaagaccagcctgaccaacacggagaaacccggtctctattaaaaatacaaaattagctgggcatagcgacgagtgcctgtaatcccagctgcttgggaggctgaggcaggagaattgcttgaacccaggaggcggagattgcagggagccaagatcatgccattgcactccagcctgggcaacaagggcaaaactcagtctcaaaaccaaaaaaacaaacaaacaaacaaacaaaaaaaccaatagacttcatttagaacagttttacatttgcagaaaaatcgagtagatcatacagagtttccacacacaccccccattcccttattattaatatcttatattagtatggtacattataatttaaaacccaataacacattgtattaactaaaatccatagtttattaagatttacttagtttttacctagtgcctcttttctcttccagggtcccatccagttgtcatatctccgtaggctcttggctatgaccattttttcaggtttttcttgtttttgatacctcgacagttttaagagcagtactggtatattgtagcagctttggtgtatcagatatattgtagaatgtccctcttttggaatttgtctgatgttttggggaggaagaccacagagggaaagtgccatcctcatcacatcaaaagaagtatatgtgagcaacatgacatcattgatgttgttgaacttgatcacttcactgaggtactgtttgttaggtttctcctttgtaaaattacttttcccaacccctttctgtactgtactctttggaaggaagtcactatgcacagcccacacttaagaagtgggtgtggagttatgcttcacttcttgaagacagtatatttacatttatttagaattcttctgttcccttagataattttttcagtcatttatttatttcagtatggactcatggatattttgcactttgggttaagatccaatactattttatttattttgttattcagattgttccagctttggccataggttggctcctatgttcctttgacatactcccacctttttaaaaataaaaactcttttgagaacttccttactttctggcactatagaataatttagtttttagagatttattttaagattaattttataccactcagtagatagaaaatcagtttatggaaaatacttgtgtttaccttaaaaattggttatgtttaaatattagcaaaatgttagagaggtattaggaactgagactttcttctcaaagtaatcagaaggtccatgtaatcttctgtctcttacacacttcactggagcatcctgtctcctttgcaactataactctttttagtatttgctttaacattgattgaaatacctataatgtgcttggtgtacctaccacagtagatagtgtggaacatataaaagtatgaaatatggtctcccatcatgaaggggcatacagttggactttgttaagtctgtaagcatggctgaaaaaaaatcacatactcctgtgtgttgtacaaaatggtaggggtgtgaggcttatatgagtttaggaaaggaagggttctgtgttgaatagaataaaaggaagaacttcttagaggttaaacccatcgtagatcctgaaggtaggttattgggtaggggggcgaggtcatttctgatcagagactgattgaacattatctacagaacaatgaatgaggaaattggcttgggtggaatcttgtgttgctataaactggagtagtcggaaattgtctgaacctgtggattagtcccctctgtagttaacaagtgtgatatgcctaaagtggtcatttctaattatgaaaggacttggatgttttaaacctgcagataaaatgtcgttagagaggttgaaaactttatccttcccggaaggtttcatactttcttattgaaacagtgacatttaagttgggtaactttgttcctgttactgcatcgtgtgttgccaatgttttaagtagggtaaaatttaccccttgtcttggtgggtaatgtaaacttagcctggcagcaaacgtagtattttcttcccagacacaaaataacccactttctttttctttctttctttttttatttttcgagacagtttcactctgtcgcccaggttggagtgcagtggcgcaattttggctcactgcaacctctgcctcctgggttcaaacgattctcgtgcgtcagccccccaagtagctaggactacaggttcatgccaccacgcccagctaattatttatatttttagtagagatggggttttgccatgttgaccaggctggtcttgagctcctgacctcaggtgatctgcctgcctcagccctctaaagtgttgggattacaggtgtgagctaccgtgcctgatccccactttcaaattgtatgtaaatatatgtaatggctttctttaagccttgtggtactcagctgttttggagactttctgatcatctgttaagataaaaatgtttttgttgatggtttttaatttcctaatgaaaaatttctaatttgtattttactttcaaagtaatgcatgctatttgaaatttgaactagtgtatatttaatatcacctttaatgaattaaatattatacttccatattttaatagccatttaaaagtttttacttaattccttcagcgttttaaagaaaaggacaggaaatacattaaaagcaaactcggcagtagatttttttttttagcaatacatgtttcattgcatgaaatagaatattttgttaatgtttgagaccatttaaaaaaccttcccttcctcagctagtccctgctaaaattctttcttaatttcttttaatttagatctcttttctatccagttaacagataaaatggcatgacacccacagatacacttactgtatgtccacattattcactgctacagtaaggcagatagtccccttcatgcatttctatatctttatcacattttccagtgtttctcccagggcaccacagtaccatttattgggtagggcatgagaatataaaagtatacctgtggatattttaaaagtaactactagagaaagaggaattggcagtattgtgtagtgataaagcacttgactaagagtctgaaaacctgtattccagtcctggctgtgccctgtgttctgtaatcttggaagccagtttttgcattctcatttggcttatgtgatctctaagtcactttccaaaattatatcatttgtgccatggttctgcaaacaaatgagcatattagtgtaacatagtatcaataatgaaatattggaataactctgcttcagttgtaaaaatgttagaatcttacagctttgcccccacttcttaaaaatgtaaacttttaattgaagtctaccttaacgtacagaaaaagtacactcatgataacataaaacacagatcacaaaacattaccagaatcccagaagctccttggtgatgccttctggtcactactactccccctcccacatctaaggatgaccactctcttgacttctaacaccataggttagttttggctgtttttggaatcacacagtatggcttcttgtgtctggcttcttttgctcagtattatgtttgtacaatttgtgtagttacatttccatagctatgtggagttttatgaatatatcatagtccatttacccagtctcctgttggactaaccatgaagaaaaaataaaataaaatgaactacattagggttaagaaattctggtagtttaaaaatacttaatgattgaatctttccattgcatacttttatgtactatttacataagcattcagattgcagatgtgtgcctcaactttgttagcctgttgtctccctttttctttttcgcagcagcgatatgaatctttccttgcttccttgactagaaaacaagaataattttctaatggttttaaaagcatggaaaaaataatggcaataatttaatatttaaaatttttaggtctaggaaagatacaagaatagtttacatttatattttacaactggctagaaagtacttttgtgttttcttaaaacatataaaattaaggatattgatgacttgtttagatacatcaatttaagtttcttttatgcagttataatttgtaagctgaatgtataggattttaaaattaattccatcaacagttactgagtacctattatgtgtgtagtcagagaactttgtcttattgtgtatatcaaatattatggtaaacggtgggtaacacatatgttttgtgatcccccaatttttcctaacatgtcaatgaaaacaaaaatgtagaagtttaaaacattttactgttttaaattcagtcatttctctgttaactctttcttaagacaacagcttgggcgggagtcacagatcactgacaagatgtcagatagtggattcggtatgaacttaaatagaaaaaaatttatgtctagtacatttactcatatgaatatcatccaaagtataaaaaattaatggttttaaaaaatggactgttatttgatgcttacctgagtttttattataaggcgtttgtatatttgaataggctaggcagttattcccaactatgtagctttttcctttactttgttttcctcacctacttatcctagagtttacagcggatttttttttcccattttttaattcattgaaaatgaatgtattgctaaaaatgaaggatttgggctaaatatttagtgattaatatacccttattgatctattctggttaaaaaaacaaacacctaatacttagtggattaaaacaacaattttgttgttatatccagcattattgtgggtcaggaatttgggcagggcttggctaggcaattcttcttttccactaaggatacatggtgatatgcagctggagggtcgtaccttttgcatgtctggtgcgttagccgggatggctggaaggctaggcttagctgggactgtcaaaccaagtatgtatctgtggcctctggtatggtggctcagagtagttggacttcttaaagggcagctcagttctcctggagaaagtattccaggaaaacagtcttagattctgcaagacttattcatatctagtcttggaagttacacaacttttgttggtaaaaaagcaagtcacaaggccagcctagattcaaaggagagaactacataagagcatgactactggtaggcgtgtttcattgggggttcatctgtggaggctagctatactacaagatctataactctgcatggtagatgtaaaacttttttttgagacagggtctctttgtgtcacccaggttggaatgcagtggcgtgattatggctcaccgcagcttcaacctctcagtctcaagtgatcctcacactgcagccccctaagtagctgggactaccgatgcacaccaccacgcctggctaacttttatattttttgttgagatgaggttttgccatattgctcaggctggtcttgaactcctgggatcaagcctgcctcagcctcccaaagtgctgggattataggcatgtgccaccatgcccagccataaaaccactttttaacagaatggtattcaaatcttataatccaagctgattttcataaaatccaactactttaatattttatgtacctataaaagcttccagggtactctgcaaatttatttcattttctcttgaagtgtgttggcctcagactagattttttttctgttttattataaaaaatgtttaagaagcaaaaaaaaaaaattttgcagtgaatacctaattatctaccactaagattctgtaattaacattttgctatacttgggttaccatatatctatctgttatcaacctgttttctggtgaatttaaaagtaagttgcgggtactcagatacagagttaaattacttttttcttccaatccaaaccttaaaggacggttagaaaatataaagaatctttattgctataccttctccctttgagaacttatttccttagaacttttaaatctgccttatcgcatacccagccaaactttggtttagttttccacaactcttactcctgatagtgtcactaagatctttgtaagaaaaggagaaactcatttatcttttttttttctttttttttgaaacggagtctagctctgtcacccagggtagagtgcagaggcacgatctcagctcactgcaacctccaccttctggttgaagcaattctgctgtctcagcctcttaagtagctgagactacaggcacccaacaccatgcctagctaatttttgtatttttattagagacacggtttcaccatgttggtcaggctggtctcaaactcctgacctcaggtgatctgcctgcctcggcgtcccaaaccaaagtgctgggattacaagcatgagctaccacacccggcccacttcttttttttttttttttttttttttttttttgagatggtgtcttgctctgtcacccaggctggagtgcagtggcgcgatcttggctcactgcaacctctgctgcccgggttcaagcgattctcctgcctcagcctcctgagtagctgggattacaggtgtgtgccaccacacctggctaatttttgtgtttttagtagagacggggtttcagcatcttggccaggctggtcttgaactcctgacgtcgtgatccacctatctcggcttcccaaagtgctgggattactggcgtgagccaccaggcccggcccatttcttttttaattataaaaacaatcatccacaatcctagtatgagtacagctactctcattaatatgttacctgttctttttccatttcatatctctacagttgttgctagtgtatgtaattaaaacatgttttgaatgtgtgacattttaaagattattatagccaaacaatgagtgcttgctatttcactgaatggctggactgctatttttaaccatgccacaacaattgagttgctttctttgcaatggaggaaagctattgaaccaaattaaatactgcttattgtctaaaattggttatatccaaagtttatcctacccctctgactcacacccttaagtaagagttgaaagtgatgaaatggcagagaaacaaagtagttggaaggaataaagatctacttggttcctggttgattttgaaactgcaaaagcaacagacaaggaagttagaaaaaaaatatacagttttcaactgtaataaaacatttttgttaagtaaattttcatttttttaaccaatattctgacagtcaatattctcatagttggactgagtaaattttttatttaaagtttacctgcagatttaagcatattagaaacctttggtgtcaagctcaagagctatgacatatgtatatttactatgaattttatttgtttttgtagtggaacttctttttgaactctagacaaacaaattgtaatcttagggatacagtcctcctgtactgaacaggattatacttaacccatcaaggcagttgagtctctaagtttttttttcagagaaagcaattcttgattgtcaagattcgttcttctcagaattaacctttactgtaaaaaaaattcttatataacccacattcttcatgttatagattcagtacatttcttgtttggccctctgtggaaacagatggttactgtttttcatttagtaacttcagatacttgaaacctaatatttgtcttttaggctttgctgtgtttgaattatgttatttacataatgcagacttaaacgtagagttttctttgtggaatactgtacccatgaaaaagatgctttctgaggattcttaaaatatgcttctggactacatttggtcatgtttgtgtgtccacatattcgttgtcttaatgagtagttaggtaatttgaactacattgcttgattgctgaactgtagtttttagaggatatgtccaaatatcagatctgtcaaccaatattataaccaaactcactagcaaaaatggtctgaatttgatctccttttaaatatgtagatttacttctaaatatgtagaagacatggggaatttgatctgggtgctgatcatctcacttttggaacatccgtagggtactggattgatcctgtgattaatttatgggtctcagtcagatatggggtgatcctagaagtttgtgtagtctgtaatgaagtgggctgtagaacaggggtccccaaccctccgggccacagactggtaggaactgggtcacacagcaggaggtgagcagtgggtgagtgagcaaagcttcatctgtatttgcagccgctcctcatcactctcattaccacctacgctttgccttctgtcagatcagtggcattagattttcataggaatgcaaaccctgttgggaactgtgcatgcaagggatctcggttgctcactccttatgagaatctaatgcctgatctgtcactgttttccatcacttccagatgggaccatctagttgcaggaaaacaagctcagggctcccactgattctacattatagtgagccatataattattttattatatattacaatgtaataataatataaagtgcataataagtgtaatgtgtttgaatgatcccagccctcccccgctgcccctagtctgtggaaacattgccttccacgaaacctgtccctggtatcaaaaagttgtagactgctgccctagagtattccagatattctgtacttgagaattactacttggatctctcatgtatatggatcttcctgagcctgtctgaagagaatacagtagtggaggaaaggagaattaaatttgccctatcatagttagttcagtgtcagcctttcctactcggttcctatccatacagcacaatacaattccatactaaagtacaagagtcctcctttaagtactgaagatgctttactttgaccacaagaatatttgaattttggattttaaccagtagtatggtagtggcttcttttcaaaatcagtgaaatttctttttttaattttaaagagagggggtcttgctgtgttgtccagcctagacgtgaactcctgggctcaagcaatcttcccatctcagcctcgcaagcagctaggaatacaaacatgcactgcagcacttgacttagtaaaaacttttaatgtaaggtataatgcagttaactaatgcttgttatgcgtttactccaaaatttaactgaaacacatttgcttgtttcatcagtgacatcatttacacaccaatgactcttggccatgaagaacccacagtgaacatagaaagtttagttgtagacctttaattgattaattgtagcagaaacggcatcaaataaggaagagcccccttcataaggaaatacagttgacccttgaacaacaccagtttgaactgggcaggtccactgatatgtggattttttcaaccaaacgtggattgaaaaatacagtattccagggatgccaaacctgtgtatacagaggcctcagtttttgtatatgtggattgtgcagggctgactatgggacttgagtatgcccggacttggtatatgtaggagtcctgtaaccaccctcctgcatgtctgagggatgactgtagatgtctttgaaaaggtctacctgaagttctgtaaatcttaagcttgctttagtttctacatttaatttttcttttagattttcatagattagaaaatgacattttgcatttaacaaaattttaaaaaatcaaaaagtttatgtatgtggttttgttttggttttggtgcaggacaatgcattgaaaacccctttctggctgggtgcagtggctcacgcctgtaatcccaggattttgggaggccgaggtgggcagattacttgacatcaggacttcaagaccagcctggccaacatggtgaagccccatctctactaaaaatacaaaaaaaaattattagccgggcgtaaggggcgcatgtctgtaatcccagctacttgggaggctgaggcaggagaatcacttgaacctgggaggtgggggttgcagtgagccaagatcgtgctactgcagtgcagcctgggcgacagaaggagactccatctaaaaaaaaaaaaaaaaggaaaactcttttttgccaggaatagctgctttgaaaatttctgtataggaagggcttaaggggtggcagtttgggtaggggagtatgtcttgaagatttattttgttgctgcacattattttcactcatagtgtatgtcatagatcattggaaacagcaaaattctcaaaaaattgttttacttatctataatacgtgtataacacataattgaaaaaataccagttatccatatcaaattcaggcatactttgttttattgtgcttcatactcttgcactttgcagatactgtatttttttttttttttttttttacaaattgaaggtttttggcaaccctgcattgagcaagtgtattggccccgtttttccaacagcatgtgtacccacttcatctgtgtcacgttttgctagttctcacagtatttcaaactttttcactattattatatctcttacggtgacctgtgatccattacctttgatgttactgttgtaattgttttggagtgccatgagtgacacccatttaagatagcctacttaataaatgttgtgtgttctgactgctccacacactggctgttcctctgtctctctccctctcctcaggcctccctattccctgagataacaatattgaaatgaggccagttaataatcctacaatggttcttaagtgttcaagtgaaaggaagagtgcacgtttctcactttaaatcaaaagctagaaatgatgaagcttagatgaagaaggcatgtcaaaagctgagataggctgaaagctaggcttctcataccagacagccagttgtgaatgcagagaaaaagtttctgaagagtgctactccagtgaacatatgaatgataaagttaaacagccttattgcagatacggagaatgtttgcatgttctgaatataaagtcagaccagacacaacattcccttaagccaaagcctaatccagagcaaggctctaactctcttcatttctatgaaagctgagagacgtgaggaagctgcagaagtttgaagctagcagagattagttcatgaggtttaaggaaagaagccatctccatacataaaagtgcaaggtgaagcagcaggttctgaagtggaagctgcagcaggttatctagaagatttagctaagatcattgatgaaggtggctgcactaaacaacagattatcagtgtagacaacactgtcttatattagaaaaagatgttacccagtactttcatagctagagaagagaagccaatgcctggcttcaaaggacaagctgactgttgagggggtattgtagctgatgactttaagttgaagccagtgctcattgaccattctgaaaatcctagggccttgggattattctaccctgcgcatgtgtatgctctagaaatggaacaacaaagcttagatgacagcacattgtttacaacatggtttacttttttttttttttttttttttttgagacaggaccttgctttgtcacccaggctagagcgcagtagtgctatcatggctcactgcagcctcaatgtcccgggcccaagcaatcctcccacctgagcctcctgagtagctgggactgtaagcacacccaaccatgcctgactaatttttgtggtgtttttttgggttttgttttgttttgttttgttttagatggagtttcactcttgttgcccaagctggaatgcagtggcgtgatctcggctcatcacagcctccgcctcctgggttcaagggattctcctgcctcagcctcctcggtagctgggattataggtgcccactaccacacccagctagtttttgtatttttggtagagacaaggtttcgtcgtgttggccaggctggtctcgaactcctgacctcaggtgatccacccacctcagcctcccaaagtgctgggattacaggcatgagccaccactccaagcctaataaattttttgtagagacagtgtttcatcatgttgcccagggtggtctcgaactcctgggctcaagcgatttgcctgcctggtcccaacgtgctgggattacaggtgtgagcctctgcacctggcctaaagttgtcttcttctctccttagtcttctctctctgtagccatggagaagttgagtcatgttaattaacacaccagtgatttctgattatggagaagataatttctcagccctattaataaaaattacattttcatttgagaggagatagtttttaaaattattttatatattttaaaatcaaatggcatatttgcttattttaacaaattttttgcaagataacccctgttaacagtttaatttgtgtctttccatatcgggttgacaaactttagcactttatggcaaaattcactgttttgtatcctgtgagccaaaaatggtttttatatttttaaatggttggaaaaaatcaaaagaatatttcatgactcattaaagttatatgaattctaatttcagtgtccataaataaagctttactggaacatagccatacacatttgtatagttaatatctgtagttgcttttgtgctgccacagcagagtccagtaattgggacaaagaccttttgtcctacaaagcctaaaatgtttactgtctggtccttaacagaaaaagtttgccaacccctgttcttcatgtacacctgctttcttgtttgctttttcaaaaacaggacataaactgtactgtgtaaacagtgaatatgcattatcttttgcttactggaaactaacttaaaatatatatccattgatcatgcatagccctccacattgatatatagaaatataacggttcttttgtttgttttgttttgttttgttttgtttttgagatggagtctcgctttgtcgcctaggctggagtgcaatggtgcaatctcggctcactgcaagctccgcctcccgggttcacgccattctcctgcctcagcctcccaagtagctgggactgcaggcatctgccaccacacccggttaatttttttgtctttttagtagagatggggtgtcactgtattagtcaggatggtctcgatctcctgacctcgtgatccgccctccaccccttcggcctcccaaagtgctgggattacagacgtgagccaccgtgcctggccaatataatgtatttttaatagctgcacagattccatatttagataacatatttcattcacttgatcccattttgataggtctgataggtttatagttccctctctccctgctacatacattgttgtgtcaaagcatgtgtatttttcatttttgtagtgattacgtaaagattactgttcagaactgagatttgtagcagttcacaaatgcaccactacaaatgtcctaacttcctagccattatttgctatcatttttttgtttgctcataagatcagtaaaaattatttttatttgcaagaccctgtcaagtaatgaagctaaatcatttgaacctgtaaagacatgctttgaagtagctgaagtttaacgattatctctgttttgtttgttttctgttttttaagagctcttaaatgtcagtagttagaaattacaaattttactgtagcaggtcatctttcttctccttgcttacaaggaagtaaccattttttagtctttccccatgacaagagtacaatgtgagaaagtttgctctgcttagcccagatctctaatgtatattgaaaacatccccatgaaaacacatctagatactgtaagaaacatctttgtttacaaagaccattacattttcactaatctttggacaatttgaataaatatgcataatagtctcttaagaaatgctggctctaggctatattatgaaaaagttgaagttgcccttatcactccagactctttttaccccttcatttgtgccctcatgtaggtgattattctggccttttcacatactaataataccactacgggttctccttcctttacccttgggaaaatttaaattctatttataccttctgagggaatttaccgtttaaattatgaaagtttttcttgcttattgaatgagggtttttttgttgtttttgtaacagctgttttgagatataattcacatgccatatgaatcacccatttaaaacatgtacttcagtggtttttaatatattcacagagttgtgcacaatccattttagaatatttttaccacaataagaagaaatcctgtatcctttagcagtcacttcctgtttctcccaatccctatagtttttaggcagctgctaatctactttatcttacaggtttgcctgttcaggacattatgtaaattgaatcatacagtatgtagtcttttgtcactggcttctttcactaagtatgttttcaagatttcatccatgttgcagcatgtatcactgtttcgttcttttttattggagtaatattctgtcacatgggtataaccgtgtgagcacataactgttcaacatttgatggacatttgggttatttctactttttggctcttatgaacaatgctgctataaacagtcatgggcaagtttttatgtggtcatctgtctttatttctcttaggtgtatactttaggagtggcgttgctggattatatggtgcctctgtttaaccttttgaagaactgccagattgttttccaaagtggctgtactgtttacattcccactagcagtatatgagggtttcaatttccccttatcctcaccaacactttgtcattttgattatagccatcctgatggtgtgaagtggcatctcattatgattttttattgttataaaatacacataaaatttatcattttaatcaattttaactttatagttcagtgttattaagcacattcacagtgttgtgcaaccatcacccgtatgttttcagaactttttcatcatattagtaactcctcattgacctctcctttcagtccccggtaacctctattctctcttctgtttcaatgaatttgcctattctaggtacctggtataagtggaaacatacaacatttgtccttttgtgtctggtttattttacttagcataatgttttcaaaggtcactcatgttttagcatgtgtcagagtatcatttctttttaaggctgaataatattccattttatgtatatgccacattttgtttatccattcatgtgtttatggacatatgggtgctttccaccccttggctgttgttaataatactgctatgaacattggtgtataaaagtatctgagtccacactttcggttctgttggattatatctgtaagtggagttgctttgtcatatggtaatcctgtttaattttttgaggaaatgcccactgttttctatggtggctaaacaggtttacattcctaccagcaatgcacaagagttctaatttctccacgtatgttcatgtgcttattgataatttgtatatcttctttagagaaatgcctatttaatttttttgcctacttctggattgctggattgtaggccaagtatattttcacatttagtaagtcttgctgaattattctccagaagagtttgtcaatatatacttcccttcagaatgtataaaagttctgatgctctaaatccaactaacgttgccagactttatttacattttttatccaaggatgtgtgaaatagtattttgtgattttaattggcatgtgcctaattactagtgagcttgatccacccttcttccctccctgcagatagaagtttgcctagtcatgtcttttttgcatttttctattggattgatgtgtttttttattgctttataggcaatattgacatatttcttacatatgttaattttctcaatttttcagaaatttaaaaacttgttttttgaagtgagaagaaagcaagttgaatttatgtccttgggatttaacatagttcctggcaaattagtcactcaataaatgtaaaatgtataaatattttacaaacatctaaaaatttgttttatttttaaggaaataatgctacccaaattaaataacaaatgagctctaattgtgcaaaaaatgtgttactcatacctttatggtaaaataatgtattggatcttccattgttcatgccgtagacacatttgtaagtggactagaaaaatagttaccagtcttttcttggtatgatagtcatttatagtagattgaatctattagatcttccagatacacttaaattctgagataaaaatatacatactcatgtaattcttagccatgacactgaagggacagggattggggagatgttggccagaagacacaaaatttcagttagatgggaggaataagttgaagagatctattgtaaatcatagtttttacagttaataaaaaaataaattatgggccgggcgtggtggctcatggctgtaaacccagcactttgggaggccgaggcgggcggatcatgaggtcaggagatcgagaccatcctggccaacatggtgaaaccctgtctctactaaaaatacaaaattagttgggcgtgatggtgcattcccgtaatcccagccactcgggaggctgaggcaggagaatcacttgaacctgggaggcgcaggttgctgtgaggtgagatcgtgccattgcactccagcctgggcaacagagtaagactctgtctcaaaataaaataaaataaaataaaataaataaaataaattacatacttgaaaattgctaagagagtagatttttaaatgttctttctcctcatagaaaaatgctacgtgagataatgcatatgttaagtagtctgacttagccattccacagtatttacatgtatcacagtatcatgttatacaccataaatatatacaacttttacttgtcaattaaaaagtaaatttaaaaatgtgaaatgagattaaaaaataaaagaactgcttacttctagaaatatatatataaattttgattatagtagcagtatcccacaaaatttccatgaaattcaacaaagggaatcctctcaaaaggaaagcaagattttgttgagccttgtactgaacttgtttaatccagacttttttccactttcagttttatgtgcatgtgaaatgatgttcattctttttctttttttttccccttgaggtaagatctcgctctgttgcccagctggagtgcagtggcacagttgtggctcactgcagccttgacctcccagattcaagagatccttccacctcagcccccacagcctgccccaagtagctggctgagactactggcatacacctggttttttttaatttttaattttgtagagatggggttctcactatgttgctcatgctggcctcaagcaatgctcccacctcagccccgcaaagtgctgggattactggcatgaaccactgtgcccagcctccattcttatttttttaaagaattacatcctacctgctttcaaaattaatatgagcctgttaaggcttttttttttttttttttaaaccacccctcttccacaaagaaaaactttaaatttgcttctggtccagcaactcaattttgtgtgacatattgcaatatatatgcccttcaaatacagttgacccttgaacaacacaggtttgaactgtgtgggtccacttatataaggattttctgctgcctctgccacccctaaggcagcaagaacaaccccgcccccttcctcctcctctgcctatgcagcatgaaaacagcaaagctgaagacttttatgaacatccatttccacttaatgaatagtgaatatattttctcatgatttttttaacatatcaccttataaaactatagaatatatataacatacaaaatatgtgttaatcaactgtttgttatcagtaaggcttccggtcaaccgcaggctattaatagttaagtttgtagggagtcaaaaattatacataggccgggcacagtggctcacacctgtaatcccaacactttgggaggccaaggtgggcggattacttgaggtcaggagtacagaagcagcctggccaacatggtgaaaccccatctctacaaaaaatacaaaaaattagctggacatggtgtcacgcacctataatcccagctactcaggaggctgaggtatgagaattgcttgagcctgggaggccaaggttgcagtgagccaagattatgccactgcactccagcctgggtgacagggagagactctgtctcaaaaaaaaaaaaagtatacatggatttatatacttgaaaattgctaagagagtagaaagaattctcctcatagaaaaatgagtgggtggtcagcacccctaacccctacattgctcaaggatcgacatagttttaggaatgaagttgatgagttttgctgatatagcttgtggttgattgatagatttcctctgggtctttctctgccttcttttttatttgaaataggctaaaacatcatgttcttagagcttgtcatttaaaatttagtattcaatacttatatcatttggaatatagctgtagtcttataattcagaaggtatagctttgcttgtaatgttttataggcctacatagtgagctcttaaaatggcactgctttaaaaaatttctcatgagtattttgcttttaacagagaaataacttgctccagagaccaggctttcattcttttctctcctggtaaaaattgactgactttctgtgagttctacaattttctgtatatatctgtcaggacaagtgttgtattgtactttattttatttatttatttaccttcttctctcccccacaatgcttgctagggttaggaaacagtcttatttaaatcctaacaatgcatggtatgtattaataattagaaggtcacttaatgttaaaaatgattatcaaataaataacatatatctttgtgttgttttcactgtctcctgctaattccaatttagtccatttttaattttctgatgattaaatgaaatttagtgagtaaacaaatcagtaaaatatagtatctctttctgctaatgtattagaaactaagttttagtaaaactttgatcgtgtaccctaggtacctgactgcaaatgttactcatccttaaggattaaggtgatctaggtgtgggtttagcagacctttgtattggaatcttatgatgattatagtagtagctaacatttataaaaaggaaaatttcactatttgttgtttttacatgctgtttaatttatctaatttaattttctataactttatatgtcatctagatgttcttagcttcattttaaagatggagaatctgaggcatgaagaagttaagaaacttgcctgggtatatagttactaaatgatgaagccagtttttaaatcccagacagtctaaatccagcactgtgctcttaagcaccatatgcatattaagtaagtttttagcttacacatgaactttgtattccaggaacagttatgttagtaaaatattaaatggtagagaattttttcataaagcaagacagataactgtcttgcaagagtcacccattcaccacgagagagaaaaataaaagaaatgtgagtgagtgagtttagggctaaatacatgtaaatactgagtttgtcagaggaatcagggagggaagtaaagtagattttttttcttgggtaagaaataaaagcatttagctcatttgcttataaaaaatagtaagaggaaaactctagcaaaataaatctagagtcttggttgaggcccactaatgcgagaacatctgacctcttggttgggctaaatctctaaaactgataggaataacaaaaatatacttaattttggtcatatcctggcagaggggaaaggagggcaggaagatagatagcctcaaaatccaggtacaagaaaggaaaggggatattcagagaaagaaaaaaaccataaaaaggaagaaatactagatggtgagggaagaggagagagataccgatcttttctatcatgcaattattggctaaatttgcttcttccagattccccctcagctacacgaaacttctaataaagggggttcttatcttctaaagcaacccctagtcctatgcatgtcaccaaactaataagtgtctttttttcattccctgttttatcctgtctttgctgcttattctgaagcacaaccacaacaaatcaaccactgtttggagagttattgcaaagtgtgatgctttgcaggtgtagaggaaaatgaaaaatagcttcttccccagagggttttacaatctagttaggaattttaaatgtaactttattaaaagataattaacaatatcctacaatattatgagttgtgtggtatatacaattccacacttacctattagctcaacctcttattttttattttatttatttatttttttgagacagagtcttttactgttgcacaggctagagtacagtgttgcaatcttggctcactgtaacctccgcctcccaggttcaagtgattctcctgcctcagcctccctagtagctgggactacaggtgtgtgccaccatccccagctaattttttatttttagtagagatggggttttgtcatgttggccaggctggtctcaaactcctgacctcaggcgatccctccacctcagcctccgaaagtgctgggattacaggcgtgagccaccgtgcccagccagctcaagctctttaaccaggtcttctcagcagggcactgtgtctcctgctttacagaaaaattaggtagaaagacaaatatcttcacctcctctcatcttcttcccttcattcttagataaaagtatctcttctcagaaaaggctcattctttgtcttgttttttctattttagcccttcacatctctaacgctggagctctgctccatgtccttacgtgttagtataaataactctgttggttccttccctcaaccctgtaaatctattactcttacatttaaataaaaacaccactgtcagctttgcagacactctcttcacccccgtctggttaaaccctttccatcttcaatcacattccttaaaagactgccttacctcccagcctcacttcagtgcattgcagttatgcttctgttcccatgactccactgaaacttctctggtaaagattccttaatactggccaaatcagatggaccatttttagtcattgtcttttgatatctttgcagtctaacattatgtctcctttcctgaacctatgactagctttctgacagtttttattctgtcttctctgctggataactttggccctattcctttctcactccaagtcatcaattctcacaactccagttatcagatatgtcctaataaagctccgaagtgtaatctctaattcaggcctctatcttaagcccaagacctagttatacttttgttataatgacctcaaactcagcagatccaaaaccacacatctttctgctccctcattccccacactgttttttttcctttgttctctatcagtgcatgttattgaaccatttattcagtcatccaaatagaaaaacagggatcttcctgtactttttatcctcttatgtaatcaatgaccatattccatcaattctgtcttgagtatcatctattaaaattatccctttatggctgggcactgtggctcacacctgtagtcccagcactttgggaggccaaggtgggtggatcacgaggtcaggagatcgagaccatcctggctaatatggtgaaaccctgtctctactaaatatacagaaaattagccaggcgtcatggcgggcacctttagtcccagctactcaggaggctgaggtgggagaatggcgtgaacccgggaggcagagcttgcagtgagccaagatcaagccactgcattccagcctgggcaacagagtgagactccgtctcaaaaaaaaaaaattatttatttctaatttctggtagataaatttctggcagtaattttttttttaaattctcagcactttgaaaattttttatatacagtagtactcaaatatctggatgaataggagttttgaaaaagagatttgactgtaacagaaaagagagaagatgattcttaatcatagaaacagctgagactgggtctcacaagctttttccctgaaattagatttcgatttgagaagaaagaaatggccagggtacataatatacaaattagtaatgcactgcacaagtgggaggtggtgggaaaaaaagccctatatactttgatgtgcaagaggaccttttttgttatatgctaattagaaagcactttgttacagaactttttggcagcccttctaaccttaggaacctctaagcaatcatttaatttgggtccatttattgtaaagaagagtatagttgacacctgaattataaaactacagccttacatttgtctggtgattcaagtataacgacatacaatctgctttcaagcctctcaccagtcaatagcaagaatttgaattccttcctagcctgtaatgtttcaaacacattatatattccccaacccacctcactcctgttaatctttcaagtaactcctatactttgatgaatctgtaccaggtattaatcaaaagagaagtgctttcctgagtcttacttgtagaaacactcttttgatggcttctacttttctgtaaaggcctttttgttttgtttttgtttttgtttttttgagacggagtctggctgtgtcgcccaggctggagtgcagtggcacggatttcggctcactgcaagctccgcctcccgagttcatgccattctcctgcctcagcctccctagtagctgggactacaggcgcccgccacaacgcgcggctaattttttttattttttagtagagatggggtttcaccgtgttagccaggatggtctccatctgacctcgtgatccccctgcctcacccgcccaaagtgctgggattacaggtgtgagccgctgtgcctggcctgtgaaggccttttgtaagtattaatctggatcattttgcctcattccaatgtcttttatcagcttttgctgttagtttatccttagatcaatctcttcatgttcataactcctcacatttagtttggtttaggtttcatcccttcacagcagtttttggtgcatgtgtgtttatagctgttatgttgttaatgttttattttgagttggtttaaatttataaagtgcaaatgtaaagcttaaaagcaacaaaaagagataaattgtttgttattacaggtttctttcttttttttttttttttaatggagtctcactctgtcgcccaggctggagtgcagtggcgcgatctcagctccctgcaagctctgcctcccaggttcacaccattctcctgcctcagcctccccagtagctgggactataggcacccgccaccatgcccagccaattttttttttatttttagtagagacggggtttcaccatgttagccagggtggtctcaatctcctgacctcatgatccgcctgcctcagcctcccaaagtgctgggattacaggcttgagccaccgcacccagcccctattacaggtttcttaatgctagtactgcagttaatattttcaaacaacttggaaacttagttaagaaaaatgattctcattgttaattatattcattaacttagcaaaatgtttataatgaatcttaatatcttaatattttggttttaaaaatcaatgaaaagtgataattcctttagttttgttacaattcatgtggatttcattgtattttaaataaaacaaaaggaaaaaggaaatatgacttgctactttgtatacacattgtttattttatttcctactaggaaaaatacttactttggggactttaagctctaagcaatagtaccttattgttaaccagtttaaagaagatccgaaaagtagtgccaaagggcaaccaaataattttagtgaatatttgcatagtgcattaattcatgcttttctgctgcctagggtttagccactcctcaaagcagcccaggttttttgtctgtatcctgcctgcttttgcctgtgtgttgtgtgctcactgtccttcagtttgtccccttttataaaatagaacactttctttagttcagagagcaaaagggcaggagaagagctatcttaagttttatttttgccaacatagaagtagtttgtgtggtaggccatctggactgagaggatttcctcggaatgtaaagtatgttgtgagatctagagagctgagatttgctttgaaactatctgggaaggtggtattcctacgcagacagaactggtttatattgcttacaacatcggtggtgggaacggaagacagcttgccttgtctcgcttcagtgtggggttcctctacccttaagaatttctgaccaggtaaactatctctccattcctgtgagttcagacctgtctcacaaacttgtgacaaaagaagtctgaggacttgggaatgaatctagattccttgctccctccattagcccccttctccctgtaaatatatgtgtcagtaatgtgataaacatttgcctacacacttgtataaagtacttaaaactacttactttataaacaaatatattcctgttgagaggacagggtgggttttgctcagcttgttcttgttctctgtgaaaaaagatggtcatgtatataaaacagcagcttttaatggaaaataatttaaaagtgcctgtcttaataatacatcagaaattgtataattaagcttgacttttacttttgtgaactctaaccaaaaaacatcatcaaaaacaattatctaggccgggcactgtggctcatgccttgtaatcccaacactttgggaggccaaggcgggtggatcactggaggccaggagttcaaggccagcctggccaacgtggcgaaaccccatctctactaaaaatacaaaaattagcgggtcaggcatggtggctcatgcctgtaatcccagcactttgggaggctgaggtgggtgtatcacctgaggtcagcagtttgagacaagcctggccaacatggtgagatcccgtctctattaaaagtacagaaattagccgggtgtgcttgcaggtgcttgtaatcccagctacccgggaggctaatgcaggagaatcgcttgaacccgggaggcagaggttgcagtgagccgagatcgcaccaccgcactcagtctgggtgacaagagcgaaactccatctcaaaaaaaaaaaaaaagtagcagagcatggtggcgtgcacctgtaatcccagctactcaggaggctaaggcgcgagaattacttgagcagcctgggaggcagaggttgcagtgagctgagatcatgccaccgtactccagcctgggcaacagagccagactgtgtctcaaaacaaacaaaacaaaaacactatacacagtgtgtggtattgttactagtttctcatggtcttcactcaacgttagcttctctaatctaacctaatcttctgccattaccattctaacctataagggctgcacagtatctcagcataagtgctttaggaaggggagatcagagactatttcaaattttttaacaacttatttgttcttgggatgatattatatctcatatcatgtaactttttgaaatgaaggactgtttttttccttaggtttgtagataattaatcttagagtcatactattaggcctcaaaactgtcataaagaccatctagtatagttgtttttatgccacaaaaccccagggttcttagaaatacaacttcatttttgttttggaacttaattcacaaaaaatggattcattgttctccaaagaataaagtgaataaatcagttatgtagaccagttatcatatcccccatctacttttacagaagagaaacatcactgaacttccctccccctccctaaaaagttacaatacatgttttaatcacgtagatgttccattatgtgtgagtgtctcactgtcctatcctctgtcatacaaccatcagaagtaactattgtcataaattttgtgtatatcattcccttggtttttcagtagttttattctaaacattgtattatttacttttgtatgtttttgaactttatataaatttcacctgacttgctctttacattcatcatgttcctgagattcaaaatgatgttgcacatcgccatagtttacttttactattctgatattctgttggttgttaatatcacaatttacccgttttacaattgatagatatttaggttgtttccaatttgtttttatgatgaactatgctgctgtgaatattcttggacatgtcttttgatgtatgtatgtctgcaggagtttctctagaacagagactgggagactgcctgggaggccacctgttttataaatgaagttttattaaatgaagttttattggaacatagccacacccattcatatacatatttctagctgtttttgtgttacaaaggcacatctgagtagtttgctccacagactgtgtggtctgcaaagcctaaaatatttaactattttcccctttacagaaaagtttgttgactcctactttaggttagggtaacacagtggaattgctgggtcataggatgtgtgtgtcttcagttttactagatattgccaaggttttttttccccctaaagtcattgaaacaggtcactttctaccagtgatgttggagagcttgtatccctccatatctttgggaacactgtatgttgtcacactttacgtttttggccagtctggtacgcataagatagtattttggatggtttcaattttcctttccaagattattaatgaggtgcttgagtctcattttatgtttgttgaccatttatgtttccttttctatgaggtgtttagaaagactggcaaaacctttgactaactatagaattgtttgtagtctcaacctccctggtctcaggtcatcctcccacctcagcctcctaagtagctgggactacaggtgtgccaccatgtctggctaatttttgtattttttgtagagacagggatgccatgttgcccaggctggtctcgaactcctgaactcaagcagtcctcctccctcggcctcctaaagtgctgggattgtgggcatgagctaccatgcccagtctggatactaatttttatcatttattatgtgttacagctatctttcccatgtgtatggattactttctctctttattatgtcttttggagaccaaacatctgaattccattgtagttaagtatcagtattttatggtttttttggtgtcttttttggaccttcctgtttgtaggatatgaagacatttgcagttattttctaaagattttatgattttgcctttaattctttaatcttcttggattttatttttgtgtgtggtggagatatgggctttaatatatggttcacccttgaataacatgggggtttggggtgccaactccctccctctcccgctcagtcaaaaatccacgtatacttttgcttccccaaaaacctgactactgatagcctactattgaccagaagctttactggtaacaagttgattcacatatttttgtgtattacatatattatatgctgtactcttataataaagtaagctagagtaaagaaaatgttattaagaaagtcataaggaaaattcatttactattcattaaatcaaaatggatcgtcataagaccttcctcttcgtcatctcaactactcaacatgagttgagtaggttgaggaggaagaggagaggttggcttgcattttcctgttaagtacttaagtatgaataagttttaaaaagtgattacttattggtagcatataagttcagagtcaggaatgatggttatgccaaaaaacaaccagttgtccatgtgggtgtctgaaatagtgacacctttgttttctgatagttcagtatacactttatttcatgcacaaaattattttttaaatactgtataaaattaccttcgggacatgtatgtaagatgtaagtggaacataaatgaattttgtagttagacttggatcccctccacaagatatctcattatgtatatgcagatattccaaaatctgaaaaatttgagacctgaaacacttctggtaccaagcaattcagataagggatactcaacctgtaatatgtttttaaaatagaagaggtcctcattttagagacttctcatataaacagttcaaaaagcttagttattcaatgtaccataatataggaaattagattggaaagggagcattgctatggataggcatagctaatcccaactgcaaagaggtaaggggaaaagtagaaagaaagattagaaaaccaaaaatgtggtctggtgcagtggctcatgcctgtaattccagcactttgggaggctgagaggggaggattgcttgaggatgggaattcaagaccagcttgggcaatattgtgagacccatctctacaaaaaagaaaattaaaaatgtaattttgtttttatttttttattttttatttttttggcaatagggtcttactcttttgcccaggctggagtgcaagggtgcagttatagctcactgcagccttgaactgggctcagacaattctactgcctcagcccctgaattacaagcatgtgccaccacacctggctaacttttaaaaaattgttatttatttgttttaaagacagggtcttgctctgtcacgcagacttgagtgcagtggcacagtcatgccttactgcagccgtgacctcttaggctcaagtgatcctcctgcctcaggactgggactataggtgtgtgctgccaccccctggctaattttttttgtagagacagggtcaccctaggttgcccaggctggtcttgaactcctcggctcacgcaatcatcctgcctcaacgtctcaaaagtgctgaattataggcctgagccatggttctcaattatttaattagaagtataatagcctctagggcatcatttcaccacagtgcttgcagcgtagtaattaatattctaaatgaagactgagtcaccaagaagtggttacattatgatggtgtgcccccactaagaaaacaagacagtaagtattctgttttagaaagatataaaatcggtaaaatccaaaggtactagaatgtgtaggcatgtcttattctgatatgatactggattgccaacttttggatatttataatgaaacacaatatacttacctttgcaaaggtgacacatttctcaacagttcagaaaaaaattaactgtgattcagtgtaataaaagcataatgaatagctatcattgtattctttaaactgtaatatttcaaactttataaagtttacgaagtcacatgtagatttccttgtatttctaaaaagagactgactcatgccggtaaatagatcagactgatagtgagaggtttctggatctccgttttctcttcattctttactttttttcttaatgagttcaaaaatgcttgagaattcatttgtatttcatattttaaccttcaaagctggaaactattttgagaaggggcaacaatttttaaaaaccagggggcaattagaaaaaatgtttaaagggaggggattaccatttttagcttatactcctactctataataaaggcggcggggggtggggtgtaaggaaaatgatctaatctacttgatcaagaaaagggaatgttaatagccctcagaaaatatattcatttactgaacagttatatcccttagtttattgtgaatgagaatgggggcatcttagagattgggagggaaaaaaaataagagcaaagttttcaaaatggaaagaacaagagcaatgcataatatagtcatcagaggaaggaactctgactcgtttgctgtgtggccatgggtaactcacctgatgtctcagagtcttagtttacttatttataaaatgatgagaggggttgttggacttcaagatagtgtctgttcttgttttagtaatctatgatagaaatttaagttatttgcattctcctttgctatgttccttataacactggaacactgtaactggaggaaacttgttttaagaagttaagcttcagaagcaatgcattttaccttaaagggcataaattaatacacatttttattgtgaaattcgaataatacaggaatacatacactaaaaagcaaaaatttatttttatttcctcttttctaatcttaccttcctagccagaggtaacccagttaccagtttgatgtgtgtacttcacaacttctttctgtgtacattatatatacatatgtgtgtgtgtatatgtgtgttttttgtgttaattttttaaaagtgtgttttggtgtgtgtctatcaattattcagtacatattgttttgcagtttgcttatccacttaagtcatcttgtagatttttcaaatttttagcttatgctcctactctgttattttaaattattccatgatattctatggtatggacatattacagcttatttaacctcatccttagacttcaggtcatttctaattttgtggcaataataaacagtgcaataaagaacatcactataggatagcaacttactgaaagcatcctgtattgccatgccatgcattatttcatctaatcatcccaagcctgatgtaagtaccagttcacatgagtaaattacacgtgaagaaagcagtcacagagttggtaaatagcaaacagatggccgggcgtggtggctcacacctgtaatcccagcactttgggaggccaaggcaggcagatagatcccttgaggtcaggagtttgagaccagcctgaccaacatggcaaaactccatatctacaaaaaaataaaagttagctgggtgtggtggcatgcgcctctgtaatctcccagctactccgagcctcagctaatagaatctgaggcaggagaatctcttgaacccatgaggcggaggttgcagtgagattgcaccactgcactccagcctggtcgacagagtgagtctcaaagaaaaaaaaaaagcaaacagatagatgtatttagtcagtgtaataccagagttaatgcactattctaccacagcttttattgaattctcaaagaaattcatgcccctgaaagggttaagagccaggattttagacaggaaggaattagagctgtgaggaactctggtgataactactatgctctgttacattgccattgcttgttgccttggctatagtgaccctgtaattgatcatccaagtcagggaacttgagagtgaaagagggggcattatgataatatttatactgagataggagacatacttgttctggagaaactgagatacttgaacatgttaaccctaacataggccatcatcacctttcacatgggttactgcaacagcctcctgtctgttcttgtgtttactcttatcctgttccaatctattttcacacagcgaccaaaatgatcttcctgaaacaaaaaacggattaaatcactcagtagtttaagccccttgcgtggctttgtgaaaggatgtatttgtttggtcctcatgtgattattgttagaatgcagcatagaataaaataaaaggcacataaggtgagagtcaaaagacttgtctttgagtctgagatacctagattagtttggtgaccttgagcaagttatttagtttgagctatttcctccagtgtaaaatatagattgtgtgtgtatgtgtgtgtgtcgggggggggaagctgaggtaataaatatgaaaggcacaatataaatgcaggcaattgttaactttgtatatgttatgccctttgaaaaattgttcttgtgtctcacagtgtctatcagggtttggtaggaattttacaagctgaaccacctttcttgtcactatccaagtttcacacaacttaaacaccttagtcattttttaaaaaatcaaagtttgtaaaagtttgctgaaggtaagttaccaagctggtactaaaacctagcaccctaaccttggcattatagcctgatgatctagtagttcagctgccttcccagaataattaagcaggttatatgtttacaaaaatcatataagcattttatctgtggtcataatataaagatatagctcatctttcatgaattgagaacattttagaaaaatatatccatatagtttactgacttaatcgcggcctttggtttacaaataatggcttgcaaaaagtgaatttattacgttacataattagctgggaggaatattggagcagctctcagaattgaagggccaaggcttcagagagtataactggaacacaaggtagttagaaccacctttatttttgacagtcctagggtgacatcctggtagctggagaaccaaggtggatgggctataactctacctctgggaaattcaagagggcttcatttggcctatcctgtatctcatgactactactcctgtggtagtattagactgagccatattaactaactcacttccttcctccctccctctctcctttcctccctcccttccttcccttttttctcttttcttttctttccttttcttttctcttctcttctcgtctcgtctcgtctcttctttttttctcttttcttttttcttttctttctgatagggtcttcctctgtcacccaggtttaagtgcagtggtgtaattaaaactcactgaatccttgaattaaacccatctttgactgggtttaagtgagcctcccatttcacttttctgagtagctgggactacaaacacgtgccaccatgcccagctaattttttccatttttgtagacatgggttctcactacgttgcccaggctggtctcgaactcctgggatcaagcgatccgcccaccttggcctccctaagtgctaggattacagtcgtgacctgccttgtccagctgaaatttctagtagtaatatttatacaactgaaaaggtcattttatatggttcagtctcatagtatggggcgcagagggtaaagtgaagcatcatagattgacagctctactaggaccaagaaatatggtggagtttcacaaaagacaagagtggctattcttcctgtgagaagaaggagaataggaaagaattttgggtagaaagaatagtgaccatagtctaacatacttacaaagaatatagatcagctagaattcagctagaccaccgtggaagtgaaaaatacttaaaatataaaaatttctaaggcgagagactgaattgttcttatcattccttaagcatctcagagttggacacatgtgcctttaagtaacaaatgtgctcaaagttttcaaattgtaacttttgtactttgtacatatcctaggcacaccctccttaaaacaatcctatttaaaggtgaagaaattaatgctcaaagaacttgcctaagattatgtaactagttaatatggaaccagaatttgaagtctagattaaagatgaaacccaacttttccttcaatatctacgtctcaaagataagactgtcagtgaaataccagtaaagacagaagagagtacatgtgtatgcatgggaggtctggtggtgtatatcatcttaaatatgaaatatgaatattgtttactgttccataatgtaatggtgatagctttggttttttaaatgttgtggtggtggttttaaactttgaattaaattaagttccatagcatattatctcagtgtgagaaaaaaacagtacattctgccttattgtctgaatgactgaaacagtcatttaaatgatctcagtgtggtccaaacagctcttacattagaatctaaaacttgccctcagtgtaagccaacggtgtttttaacagttagttatttccctgaattttcctgcttatactgaatgaaccaatagcaattaatgttttttttgttttttgttttttgtttttgttttttgttttttttttttttttgagacggggtcttgctctgttgccaggctggagtgcagtggcgtgatctcggctcactgcaacctttgcctcctgggttcaagcaattctcctgcctcagcctcccaagtagctgggactacaggcacacgccaccaagcccggctaattttttgtattttaatagagactggatttcaccttgttggccaggatggtctcgatctcctgacctcatgatctgccctcctcagcctcccaaagtgctgggattacaggcatgagccaccgcgcccagccagcaattgatgtttctatatgtttggattcttattgacccaacaaatacagtagtatagtctaaagttacataactttgcaagtcctttgtaattgctgtggtatagctaagccttatttgaatagtctttctcttgttgctgttacatacctaaggcaaatattaagtatttacttcataaaaacctttttttaagagaggttgtggtgttaggtggagagaaggagcagcaaaaggtcttttgttaattacatagcaataccgagttctgtggggtgtgggagagtatgatagtaaaaagtaaagtagtaaagatgcttcctcatcattgttggttaaggtgatagactccctatctgatacataaaaccaaacaagtgatttatatgccttttctgttttcatagagaactgtgataataatgtaattaagaaaggttaaatagtttgctgtcttggaagtttcctgatgtctacaagatgatgtatttagggagccttttcgtgagaaaaccaattaagatgatgttgtaaaaataggggaaatttgaccgtggggacaattgtcaccattttaatgatttgtgaagtttattaacttattttaaattaagatagctataaaagtctttatagaagttaatatgtgtcaacatgatgagatgttatggagttttttgttttgaaattttctttcttttttttttttttttttgagacagactcttgctctgttgcccagactagagtgcagtggtgcaatctcagctcactgcaccctccacctccggggttcacatgattcttgtgcctcagcctcccaaatagctgggattacaggagcgcatcatcatgcctggctaattttttgtggtgttagtagagacggggtttcaccatgttggccatgctggtctccaactcctgacctcaggtgatctgcctctcttggcccctcaaagttctggaagtacaggcacgagccacttcacctagccagaatttttctcatcttttgtaagtcttatgtgggatggtttttctaatcagaaattacttctcaagcagtttacttaaaaatattccatattttattttattttatagatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggtaattgtgttgtaaagttaaaaagagtcttgctttttgcaatattttctttgaaagttgaagctggaaatataaaactagtttcttatgtggattacttgtgattatagtttgttttccatttcgtttttttaattcccaaaaagttctgaaagtttattctttattatttaaaataaagaatttttgtgtaatccactgattatactcacaggttttttatgttacagtatttgtgtgaagttagtatcttccaactagatgataagtttactcagggcaggaactgaatcatcgttttgtgtctctcatttcatattgaacataggtggtaggcactcatgtgttcttaaaattctgttgtcaatacagaaacataattaaaatcatcatagtttaaatagctttattctgaaccctctgtggttgttagcagaatcctgaaaaaattaatttaagctctgaagcttacgagcccagtataatgggacttctaactttccagtattgggagttttcaaggttgagacaaacagtcgtcaagaccctgttgctctgagtttggagcagatgtagtgtaccttttcccttacttcaaccaccaagaaagaatttattattctttcacatgaatcaagatttgaacatatcatttgatgtctcttactgatttattggtagagtatatggggataggcgtgattatgcccattttggcagtgggaaaagtgaggacatttattggcttgccttcctacttcgatgtcaatgtaaattattaacctagggaggagttttatataactcccaaattctagctgagtaggagatagtgcagtcagccaaccagcaaatgagaagcagatttagaagaaagattgtgaattcagtttctgaatgttgtttagggtgtatatggtatgtagagatacatattggtagctgaattacatatggatctagtgctcatgttagttttggctagcagtaagaatttgggaatgttcctcttatggatgatagttgaagccatagaggatgtaaaatgagaaggcagtccagcatagttccactgggagctccaacatttcagcatagcacaaaaagtgatgcacattgccagctgcttacagagatgtcaaataaaacaaagactgagagatgaccattggattcggcatttacagcaatattagaaacctctccaaaagcaattttagtggagtaatagaactgcaaatcaaataccagtattttgagaagcagcaattaagaataattgtagaattgagagcaacaaatatagccactctcaaaaaattcacctgagtggaagacggtggtaatagctaggagaggatgctatgttgaaggccagttttaattactttttaaaatttgttaaaaatatgtgatagacttgaacacaaagataggttgaggacaaaaaggcagcagagaggaagaccaatacggggaaatggggtggtaattgatgaggcaagtgtcctgagaatttgagaagggatctttgagaaccacaacttctagccctgataactgtgaatatatatcgagataatgataacctttaggtgcaaagataggtcgtcagtggtagaaaaaaagagaatgcatgtttgaaatggttaaagcggagaatggaagaccgtagacatttgaaagagatgctgagagaccctgaggctatggaggcgggatacttattgtggaggaaaggtgagtatcattctgcccggttttgtgattcccactcttttccctcttggcctcatgtactctgggtctgtgtatttacagtggagagttagatggaagaaaggattgatctttttcattagtgatagtgagataaatatgtcaatgacaaaggacaaggggcctgagggtttggcaaaagacttgataaaaaccactttgactaataaagtgttatattatgcttgcttgcttgatttatttatttatttatttatttatttagagagtcaactttgaggaccgccaagatcaagccagaaaacaattttgtttggttatgaattgatttttataggaggattttggatttttagagtaggataaggagctagatctgttaatgtatatgggctttatagggaatataagctttgtatagagagggaagaacaaatttcctatatataatatacagactcagaacccgagggtacatataagtattttaaaacctataatagaaaatgataacgatgtttgattgctattcacatttttaaaagcttattttaaatagtttatattagtttttttaaacttttttaggagacacggtcttactctgtcacccaggctcactgtaacctcaaactgctgggcacaagtggtcctcattcctcagcctctggagtagctaggactacaggtgtacaccaccatgccctgctaaaaccttttcttttttttgtacaggcggaatctctctatgttgcccaagctggtctcaaactcctgggctcaagtgatctaccttggtctccaaagtctttttaatatgctgaaaaaacagtgcattgtaattttatgtaaattgagaaaaattttaaagatattttctctcatattgtatctactaaggtatttcagtaaagaaaattctgaaatattttaaagaaatttaaaaattgcttttttcccagcatatacacagtattttatatgacacatgagttatttagcacctacttctcaatgtcatgaaatataaatacagttaactagctataattactattccccaggaacttattttctgtaagttgtcctttctggtccttttctaattatccttagtcataattcctatgtctctaaagtgagtctaggatcagtttggttaatggctctttttctggagccacagaaccatctctgtggaactttttcttttcacataacactaacttaattctttttaataaccttactaattagagattttttttccaattgatttttaaattatacttcataattaactttgctattttataatatgctaagatggttcattctttgagttactctgttacctggaacacaggcagtttatgaaatggtttgatgggggtattgattatataataatttgagaaaataattatttcatagatgagcataattcatgttaattactgtattttcctttagtggaaaaatatgtccaactaattatgtttccaatagtgatattaagacattgagagaaatacatatgtaaagtttcataatgttattggcaactctgaacagctttatcttggagtttatttatagcatatcgttgaaagcaattggaatttaagtgactcttcactattgacatttgtgtacagcctaaaatagatcatctcagttttgatattaaacaggattgataaattagtggtaagaaaatttggaataaacattttaagcaaagtattttcaaataaatgaagtttttcataacattaaaaatgaaattatcttgtagggatttgtattttttctttaattaaaaagtaaagtcattttttatactatagacagttttatgtgtgattttttagcccctgtgaaattagaatttatagtatcgagtatcacataatttattgacaggaaaatgatcattatcatcttaaggtgtttacattttctagaggatttttctttagaggtcaaattaaattcctgtggataaatagggtagaatccttttatgaagctgtggttcaaaggacaagtcaacttccctattactgaagagagctattttatggttttgctagatggtggtgatatgggaaggacataagttgtcatcagatatgaccaaaagtaaatgctaatgatgtgtgtgctaagggcttaatgaaattctgctacgttgcttcatagtagtattgccattcagtaaataccaaaatcagaaacacacctaacctttaaatatatttcgttgtcttagtttatcttctgcagtgtgccagcagtatttaaagctaagccccatttttttcttgagtaaattatgcaggacacttgactgaggtagaaaattttcccatgagtttttaaggtggccagtcacttaaatttttcatataccttctcctctgtcagagaattctttccttttgacggcatgtgttcataatatatgcaccagttgcagctgaatccctgccaaaagaaaaaaatattacctgtacttcggagcaaaagggaaggcccagagaacactggaagttttagctgccaagaagatgaattatgtcacagctggtgcctgggaaactcattaggacctcttgaggtgaccaaatgaatgtaatttgagaacacagcccagtggcattatgtgaagacaaactgttagtacacaatgatacggaagttaaaaagttaaatttatctgaagttggcagtcagtcatgtaaaccaggaaactgctggttaagccaaagtgtgaagcattgtaattgccacttgagaaacgaaagaacccaaaggcaaaattgaaatataggggtcagttctccaaaagaaacattgctaattatgtaaaatctgggatactctaaaggcacagatttgtatcattcagctcctggtccaaataacatttgggaggattcagggattatcataggtttgctgtaaatgttatcgataagcacattacctccatcagcttaggaaggtatgaattgccttggtgggacccttacgctaaaatgactagtaattgtggaaggggatgatggagtgtctgattattttgtgtgtagaagtatagtcatgcatcacttaacagggatactttctgagaaatgcatcattgggcatttttttccttgtttgagcattatagggtgtacttgcacaaacctagatggtatagcctagtatgcatctaggctgtatggcatagcccagtggtcaccaacttttttggcactagggactggtttcatggaagaccattgttcttcagactggggtgggtggggggaggtgttgggatcattcaaacatactacatttgttgttgtattcttattgcatagtaatatataatgaaataattatacaactcaccataatgtagaatcgttgggagccctgagtttgttttcctgcaactagctggtcccatgttggggtgatgggagacagtgacagatcatcaggcattagattctcataggagcatgcaacctagatccctcacatgtacagttcacaataggatttgtgctcctatgagaatctaataccgccactgatctgacaggaggctgagctcaggtggtaatgcaagtgataggaagtggttgtaaatacagatgaagcttcactctctggcttctcacctcctgctgtctggcctggtttctaacaggccacaaaggtaccagtctgtggcccaggggttggggacccctggtatagtctgttgctcctaggttacataggcagttgtaacacaatggtaagtatatgtatatctaacaaacctaaacatagaaaagatatggtaaaaatagggtattagaatcttcttggaccactgtcgtatatgcagtccatcgtggaacaagacattatgcagtgcatgactgtatattggcaggtgttgcctcagaccaggtaacaattactgtttacagagtgccatttctatatgagagtcaaatgcttctttgtcacttccactcaaaatatacttttaagtagtggccacaagttgaaaggcctaagggtacatcttcctgtgaaataagaggaaggtagaagtatacagataaaattccaaatggagaagatagaatttgatggagtacatgtagtcctcaatcttctcaaagactgaagcaagagtaatcagccaattgagaaaagtgacgaagagcctgaaaatgaggagtggaagaagtatgtatacagttggagccatgaggcatgtgatggagaattcaagataaatagaagatttgggatatcaactagactatctctacccttctgatcaaaactgtaaccatcttaaaggcctcagaaattatttcctgaaaatgatctattttttggcacattttggaattattttaaatttttgtttgtacttctcttttggcatatatatttgttgctcccactaggtgatacactatttgaaagcagggacagtcactaacatagtcatcccaaggctagctgagaaacaatttcaatttacaaatcaataaattgtttgtaaattgaatgccagaagaagttagttatagaaacaggaagttgtgataaaattacagttttagagagacagattgggatagatgcaagaataagaagataatatgtaccggagtagcaagaaggatttcagattttgagctttggaatatgcggcagttcttagtgataactttactgtgttagtctacatacagtacactgaaatttatttgtatttaggaactgtcaggctaagatgtcagtaaggtcgtctacttgagtctgtcattaaggagtgtaaactatagtgaatagcattcttttgtcatgatcaagtgtaaaagtttttattgaccttcatcctggcattatgatggtttccaccgtgattcttaaaacttccttcactttttcattcacgctacatagctcttggtccccaccatcttattctcagaccactgccctgaaatcagttcttcacatggctactagagggtattctctaaaatgtaaattgaactctgcttttcagcttaaaaccctttagtggttctttattctttatagataaagtctgcatcatctgaatgctacttaactcctctctgtgaactatcccctcttttgttctacgtgctggccacatcaaggagctttttgtctccccaccaccacccactcaatgccgcaaatacatacactctctttgctgttagagtgtttctgttcctttacacatactgcaataggatcccattgtcttatcaccgccctttcagctgtctatttctttcttattctttaaggccttattctgtgttttttcaaggaagcctttcttgagctctgtgtccctaatccttatagaattatgtgtcctttctttgcacttccatgatactccattgatatctctctgttactgtacttaccacgttttcattgccaatgtgattctccttgaagattttgaattccttgatgtcagtaactgccttatatatgtttgtaaacataagagtaggattataattggtcctgagtaaatatttgattggtgcatggatgatgaatacgttacagtttaggcaagcagaggtgactagcatatgctggagagaaggatcatccaggtgcagaagtgcagaagaataaaaagtacttagtttaggaattcagaataaactgaagcatagggtgtaagattgggagtttcaagaaatgaacctagactggtagggcccatagtggaaggttttcttacaccttgttaaggaatttagttttcatcctgaaggtagtggagagccactaaagaatcttaagctgaggactgacaggcagatttatagtaattcgtccaagatgcctatgtttttgacattttaacatctctgaaattacgatgcatattacaattgatagtgtcttacagttctaataggaaatacttctttctaatggtacttaaaataatggggcatattacagttagtggcattaaatttaaagatacatagcatgtggtaggtcattctggcacagtgtagcgatgccatagtgtagggtaaaactgcaagaagagagactcgagataaactcaacataatccaaaagagaaatttggtagtgaagatgcatccatttagttgttttgatattaagtactttttgtgtgctaggcagactgctcaagagttatttcaaccctaattcgagttattaaagtcatatgccagggggaaaaaaaagacaaaaaacaaaaataccttgactctcacctcacgccataaacaaaaattaagcaagatggatcatagacctcaatgtaagggctaaaacttatgtaagaaagatcttagtgaccttgagtttgacaaagatttcataagtagcacacaaacaagcataagctataagagaaaaatcaattaattgaatttcatcaaaatttaaaaatcttgttctttcaaaaactgttttgaaaataaaagggcaagctatagaataagagaaaatatttgccagacatgtatttgtcagaggacttttatgtagaatatttgaagaactcatatgcctcagttattaagaaggaagcccattcttaaagtgggcaaaatgtttgagcaattgaagttgttatgccatttgaggcattggtaaaagaacggtaaaaatgcctgtaattggtggtcgggcacagtggctcacgcttataatctcagcactttgggaggcagaggcaggtggattgcttgaacctaagagttagagaccagcctgggcaatgtggcaaaaccctgtctctacgaaaaaaatataaaaattagccaggcacggtggtgtgcacctgtagtcacagctgctcaggaggctgaggtagacagatggattgagccccgggaggccgtggcagcagtgagccatgattgtgacatggcactccagcctgggcaacagagcaagactctgtctcaaaaaaaaaaaaaagactaagaaagaagaaaaaactaaatccaaggcttgctagagggaaggaaataaagattagagcaaaataaaggaagtagggaatagaaaaacaatagaatcagtgaaaccaaaacttatgaggtaacacttaataccctcttgagtttttttttttttttaacctgaaaataacaagtgttggcaagaatatggtgacattggaatcctcatacattgctagtgaaattgtaaaatggcgcagccactgtgtttggcagttcctcaataagttgaacatacaacaaccgtgactcagcagttccgctcctaggtatatactcaaaataattgaaaacaggtggttatatgaaaaattttacacaaatgtttatggcagcactattcccattagccaaaaggtggaaacaatccagatgatcatcaacagatgaatggaaaaacaaaatatacagtggaatatttttctgttataaagaatgaaatatatgtgctacaacatggtgaaccttgaaaacattgtactatataaaagaagccaaacaaggtatggcttctttggagggtagggtacagggagtgactgcttaatggatacgcggtttttgttttttttttcttttcttttctttgagacggagtcttgctctgtcgcccaggctggagtgcagtggtgcgatccccactaactgcaagctccgcctcccaagttcctgccattctcctgcctcagcctcccaagtagctgggactacaggcgctcgccaccacgcctggctaattttttgtatttttagtagatacagggtttcagcatgttagccaggatggactcgatctcctgacctcgtgatccgcccacctcagcctcccaaagtgctgggattacaggctgagccaccgcgcccagccaatggatacatggtttctatttggggtgatgaaaatgttttggaacttggtagtggtgatggttgcacaacattgtgaatatactaattgtcactgaattctacatttttaaatggttaaaatgataaattttaggactgttttaccacagtttttaaaaagctactgatataacaataagtaacttgtttgacgtactagaactaaatctgatgaccagtgatatttgcataatttgaggattaatgtaacttatatgtaaaaaaaaaatttcttaagaggtttcaaaaaataaatgcagcaggtctcctgcttcctgtcttctaattcattcaatctaatgtaggacttacgaatctatattaaggaagcacgttaggtgattatgacacaaatgacctccaacatcttattcttgacaaaaatgcagtgttataccaccatgtgtggaacttcctaaggtactagatattacttgtgtgcacgtgagaaaactgagtccaaaaattaaaaaataaaaatgttctctattcccaaatctttacttgactcttagtatagataggactgttttatcttatgatgttgtgtcttctgaccacactaatataccagtcacacatttattccactccttgtatatgtactgtgtaagttaaaggagaggttaactttatatacttatgctttatttgtatggagtaacagtctagaatttaatatttatggtttctaggatttaaaatttatggttttaacaagctgtttttgaagactgatggcatgggatttatggattacttgaggcacacatttgaatcatgtgttataaggctgctgtgtgtggtaaagcaaaccatttagctaagagaactagcccaactgtgttttagtaaattagtatggctttcctataggtctgtttcgatgggattaagtcttgagacagtatcatgtgctgcataccatgggggcattctgctcaagagttataaacaataatatacttaattttttttctaccaccccctccttccaaatggacttaattttaaaatttagatctttaaggaatatattcaaatttgatataatttttttccttaattatctttaggccaaccaagccctcgagcagttattcccatgtcctgtataaccaatggaagtggtgcaaacagaaaaccaagtcataccagtgctgtctcaattgcaggaaaagaaactctttcatctgctgctaaaaggtacccatttatgaaagggggaaaaactaacattgcagaattgtctgaatgtggtagagatctccctttagaaagaatatgaaatagagctgtttgaattcaagtgagcatgtcctttgaattcttaaactgtgaaagtagagacatttagcctgtgctcactcagcttgcactcatcatgcctgtcaagttgtgtgaggaagctttccgttctcactaaagaaagaaagcagtttcatttcctggttttgttttgtttctttgtaacaagtatttattgaaagcatcactatatttaaagaaattatataactgaattttccatagcaagtgatatatttgatacagcatttttaaaggcaaaacagaatcttcgatatatctatgttagtgggaggtcaaatgctattataacttttattttttaaccataactataaaattaaggcttatttcaaaaatatagtactatctggggtgtgtgggggtgtatgtgtgtgtgtgttaggggatggtgggcaggagggctgtggaattacagcaatataagtttcagtggattacagatttgcattctttatgttcttttcatcagttaactaatttactccaataaaagtgctcacaggattttcccccttttgtaatttctagcaaattattcgatgtagagtttggagagaccataggtgatcagctacaaaatcttaaaaccgttttcttcaaagaatgagtgaggaaaaatcttaagtaataagatcatgtgtaacaatgtactgatggaaaatgcttacctcaataaactaatgctagtgaccgaattattcattggtgtggattcatagatacttaaccaaacagttgatgacaagaatgttgaagaaataccaagatcttcagcccttttaaaaattccgtctagaggccgggcacggtggctcatgcctgtaatcccagcactttgggaggctgaggcgggcggatcacgaggtcaggagatcgagaccatcctggctaacacggtgaaaccccgtctctactaaaaaatacaaaaaaaatagccaggcgtggtggcaggtgtctgtagtcgcagctactcaggaggctgaggcaggagaatggcgtgaacccaggagggggagcttgcagtgagccacgattgcgccactgtatcccagcctgggtgacagagccagactccgtctcaaaaaaaaaaaaaaaaaattccttctggaactcaatctttgtcgtcgtcattacagaatctagactttcccctacaaaggatgctaaactttattacctgtactccactttgagtagaaaaagggaaactaagaaaatgttagaaaattttagtacaattttaaataaatttccgtgttgtatccagtagtggttcagattcagcccattttcttacatagctattgcactgttgcttgttgctgtgtagtgatcagtattatgcacattagtgattcaacaatccaaggccagctgagtttgttagtttatgatccagggtccctgtattttgcttttaaataacccagaaggaaaatggctcttttaggttgtactgggcccacataaaactagtgacctctgtaatcttgttgaagaatcgcaaggaagaagtaacttctgttttttgtttttgtttttgagagagttggacatattggaactcagttttttaatttcagagttaatctgatattcttgaagtataattgtatttctttttttatttattttttaagatatatatatatatattttttgagatgttgttctgctcttgttgcccaggctggagtgcaatggcgcaatctcggctcaccgcaacctgcacctcccgtgttcaagagattctcctgctgcagcacccggagtagctgggattacaggcatgcgccaccacacccagctaattttgtatttttagtagaaacagggtttctccatgttggtgaggctggtctcaaactcccaacctcaggtcatccgcccgccttaacctcccaaagtggtgggattacaggtgtgagccactgtgactggccaaaattgtatttcttagcacctgcttttaaaaaaattgaacacaaagtagatagtcaagggccagtctgaagtcagaagttatcagaagtgcatcaggttaagaaatgtcacttgacattaaaatatctataacattttaaactattataatgtgataaattgtatatactatgtacatttatttaaaatgttcttgaacaagcttacttgttgattataatcgaattacaaaatgtcctttgattaagaaagacatgtaaatgggaccggatgcagtggctcacgcctgtaatcccagcactttgggaggctgaggcaggcgaatcagctgaggtcaggagtttgagaccagtctggccaacatggtgtaaccccatctctgctaaaaatgtaaaaattagctgggtgtggtggcgggcgcctgtaatctcagctgctggggaagctgaggtgggagaattgcttgaaccttggagatggaggttgcagtgagccaagatcataccactgcactccagcctagatgacagagcaagacttcatctgaaaaaaaaaacagggggaggggggcggcagagaaaagaaataggcatttagtagtttcctaccttttcatcactggaattcaagtcttgattccatcagctttataatattgtcaagagtgttttcagtataagtatgcttatccagtctggttaggaatagcaggtggtttattaaccaagagtcaaagtacataatcaaaagaatttatacttaaatatctgaaatattttaacataagatacattcacctgtattcattcatcactttttaaatgaaagaccaaacctaccctctaagtatatatctctgatcaaattccttgttgactgtctttcataaaatatatccataaataactttctaaaatttttagtttcatttctcagaaatgaaaggagtaagaaatttaaaactctggcagaagagtatgttagaacgcatctctctttctatgattttgtttctttctttctttttttttttttttttttttttttgagacggcgtctcgctctgtcacccaggctggagtgcagtggcgcaatctcggctcactgcaagctccgcctcctgggttcacaccattctcctgcctcaacctcccaagtagctggggctacaggcgcccaccaccacacccagctaattttttgtatttgttagtagagacgggatttcaccatgttaggcaggatggtcttgatctcctaacctcgtgatccacccacctcggcctcccagagtgctgggattacaggcgtgagccactgtgcctggccaattttttttttttttaaagagacagagtctcactttgttgcccaggctggtcttgaactcctgggctcaagtaatcctcctgccttggcctcgcaaagtactgggattacaggtgtgagccaccacacccgggctctgtgatttgtttgttttttgagatggagtctcgcactgtcatccaggctggagtgcaatggtgcaatctccgctcactgcaaactccgcctccctggctcaagtgattctcctgcctcagcctcccgagtagctgggattacaggcacatgccactgcgccaagctaatttttgtatttttagtagaaacggggtttcaccatgttgcctgggctggtcttgaattcctgacctcaggtgatacttgcctcgccctcccaaagtgcttggattacaggcgtgagccagtgcgcccagccgcctctgtgattttttaaattgtgtcactcacactaaatttaacagcaatttttttgataactcattttttttgtagtctttctagaacattaaacttagttttcatagaaattgcaattctctttgtatttaattaacttacataattaaaataacaactggcataaacagacttggggaaaacttaaactcttggtaagtttaaaactcaattgagtggagtagaagtatacagaaaaaaaacaggaattggagaataacctattaaacatgaatatttagtgttcttttggcatcagtcggtatgctttacacagatagtcctctgatttgggtaacttgaggtcagttaagagaccttcatttgtcccccaaaatctgccaagatggcaaagtttattagagaccatttctgtctaaaggggcaatcttcatggggtgtatcgccttagaatttttataaattctttactgaagatgttaatagcttctggaattttcaaagaaatattgtccttattgaatgaaaacagtgcaaattgtattagctgtatgacttagggttttgaattatataataatcacttttctatcgtttgattttttttcatttgtttaaatgtgtattgttccatgttatactttattttacagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaaggttttaactgtccccaagtacagagctagggaatggttgtaatgatacctaaattctgtgacttgggaaaaagttagctatccaaggattctgagagaaaaagctggtggctttatttttcccttcttcattgcttataatttatgctttatagcccattggggaataaagaattaaggtcacaatttctcagttaaaactggaaaaaaaaaaaaaaaaaactaagttataaacaatctgatgaaaagaaggcaggaataacctagtcgaaaaccaaacaatattttcttaaccacatttttgaatacttttaaaatatgtatgtaactatgcataaatttatagccatggatagaaaatggccatatgtaattgtcctcactgtattttggcatcattacaaccttcaacctgcaagggcccatctcaagtggctcttcactgtggctgcatctcagtttcagttttgggtcttgggaggataagttcttgcttgagtagagaaatgaatccatttcacctggtcttttctatgctaaaggcttgcttgagggcttctgtgtccgtaataattaatattttaaagttatgagaaggggaaaagggagaaatattctaacaatgtgtgtgagcctaaattgagaatctaaacctgcatgctgggagtacagtgctacagctgcctcctaatcaaatattgagaccaatctaattaaatttgcctgtttagaaatgcttattcaagccttgtgattaggaatagtcatattttatcatcgtacttctgcttggaaatcttaggaaactattaaaccatttccagaactggctagaattttaataaaataaatgacaaccattcctaaaagatttaaatttttatttgatcaatttaatattttgcctcaaatcgctaatggaaattgggaaaaccaaaatacccttcacttgatcgatgcatgtttaccacttacaaaatgctttgtctgtgtgtctcatgcagattcttacccaatctaaatggtttgtagtttatctgcctggtctcctgtggagtttttcttggatatagcttattaacgttacataactttggattgtgtgtggtttaaggtggctttttataatcagtctctttaaggttctgatttcacttgatatcttctttgtcccagcatctttttttcagcttcttgaggtctcctggaaatgtgcttgccctcctaaattgctctttggatatactgttgcaagaagtattggagactggatgagtttgaggatagttagcaatgcaatgaaaaaatcatttgtaaagaaacaaatttcacttataagtatagggaatcaggattgccaataaccacattcttatataaagtcttgtttatttctgatcattggtaaaattgtccctaaagatataaacaagagtttataccttgttatatttagaaattgtcatttgtaccatatgtaatgtaattacctgaggacataattgcacaaaaaatgaaaatggcagccttataaaattcaatggctatgaaaaaatacaggtttttttgtaactacaaattataagaaacattactcagatgtaaggaaataatttttttctgttaacaaaagtgttttttaaaaaaaatcaggtaatatttgttctagtgaatcttctgagtgatacagaaaattataatacagatttgggaattgccttgtttaactccttcactcatccaggcagtctttcaactaatccttctcttttctggattagctttaaggaaatgttaattgctgcttttgtgttctgtttaaattgtcagttacatgtctttgatactcagaatttttctctaagaaattaatgttccttctagcataaaacgaccatcaccagctgaaaagtcacataattcttgggaaaattcagatgatagccgtaataaattgtcgaaaataccttcaacacccaaattaataccaaaagttaccaaaactgcagacaagtaagtattgcactttcttcattatatctgaaaagtaataattatttggctattatgtttgcatgtacagttatgtatgtctggtttgaatctttttttttttttttttttttttttgtgacagagtcttgctctgtcgccaggctggagtgcagtggcaccatcttggctcactgcagcctctgcctcccaggttcaagcaattctcctgcctcggcctcccaagtagctgggactataggcacgtgccaccatgcccagctaatttttgtatttttagtagagacggggtttcaccatgttggccaggatggtctcgatctcttgacctcatgatctgcctgcctccgcctcccaaagtgctgggattccaggcgtgagccaccacgcctggccttggtttgaatctttttaaaaactctgtattataatttatacttctcttatggagtctcactctgttgccaggctggagtgcagtggcacaatcttggctcactgcaacctccgcctcccaggtgcaagcgattgtcctgccttagcctcccgagtagctgggactagaggtgtgcaccaccacgcccagctaatttttgtatttttggtagagatggtgttttcaccacgttagccaggatgatctcgatctcttgacctcgtgatccacctgccttggcctgccaaagtgctgggattacaggcgtgagccaccgtgccagcctggtgtatgttttctttcaagtcttctacaaaaagttgtatctaccttttaaggctcccaactcaaacaatacgtgttttttttttttttttttttttttttgagacagtgtctcagtcgtccaggctggagtgccatggcaccatcactatcatgtcttactgcagccttcaccttcctgggctcaggtgattctcctaccccagcttcctgggtagttgggactacagacgcgtgccaccatgcccaactaatgtttttgtatttttttgtaaagacagggttttgccatgttgcccaggctggtcttaaactcctgggctcaaacaattcacctgcttcagcctcccaaagtgctaggattacaggtgtgagccactgtgcccagccaaataataaatcttaataatcatataagatttgagtatttttcataagttatttttatgctttcactgtttagatgctcttgtgggatattcattgttttataaaatagtgtatattagtagttcatcagtgagaaactttaaaaaatgctgatttcttactttcacttccagagatttatctagattatagcctaagcattaaaacttttacagtttcttgaggtgattttaatggttagccatataaacttataaaataaatgtgtttcttaaatttcttttctaggcataaagatgtcatcatcaaccaaggtaaattaaaaatccttttaaaaattttattttgcccttcttagtttaatttttgctaattgaaaagaatattttcatccagtgcactttatcagttcatagtaatcaaagaaaagtgcgttactgtagtcatttaggaaaaaacccagtttttattgtaaggtaatgtcatttttgtctcaaccagcaaaaatgtcaactcgcgaaaaaaacagccaaggtaagaataagctacgcagttggttgccttctaagtgaattttttcctggatctcttatttggctttttattatttatgctgcctgactttcttccttaaaaaggaaatacagtgatttgagctagatgaatccagctacattttacttttttttttgagaccgagtctcattctgttgcccagggtggaatgcagtggtgcaatctcggcttactgcaatctccacctcctggggtcaagtgattcttgtgcctcccaggtagctggggactataggcaccaccacacccggctaatttttggtgttttttgtttgtttgttttgtatttttagtagagacggggtttcaccatgttggccgggctggctgcaaactcctgacctcaggtgatcagcccgcctcagcctcccaaagtgcagggattacacgcatgagccatggcacccggccaatttttgtatttttagtaaagatggagtttcaccgtgttggccaggctggtctcaaactcctgacctcaagcagtcctcccgcctcagccccccaaaatgctgggattataggcatgagccaccacacttggcccggctgcatttttaaaaatccatcttatttctaagaaatctgaagattcaaggtgaacagtaaaaatacagtattacaaaaagggataaaatactagagggagttttctcccttaaaaaaaagttttacctagaaataaacgattgataaattttaactcagtttcctgtcttgccaacttcattgcaaataatcactcatttcttgatgctaagactgaaaatatgatgagtctagcaaatccatttcctcttaagtttttcttttatattgattgtaacttctggctacttgctgttgttggcttgttcagaccaaaaaaagagagcagacttttggcgaatgcgtatttaatttaattgcactgtaggtaagttttatacatcagttttacattctctttagattgcctgcaaatttaattgaagcatgctgttcttaatgaaagcacgtcctttctgtgcatggttttcacagctcatttctatgtttcatagttagccttattttctgttctattatagtaaccagctgcaacgtggttaaagctttttttagagatttaacttgatttctgtggatttttacttctttcgttccaaaaagaaaagaaagaaatatttgtaatagtctttaggtcatttgtttttacatagacattctaaatgaagttgaattttgctggcattcttctttagtaggtcttactttctcccttctttataatacaacatagattaagtaatgtttgagatactttaaagggaaaaatgaaattttatttatgaagataattcttaatacattatatatcaaaacttttaagagagagggtcttgctctgttgccccggctggagtgcagtcactgccttggctcactgcagccttggcctcctgggctcaagcagtcctctcactgaagcctcccaagtagctgggactacaggcgcgcaccacatacctggctgatttttgtatttatcatagagatggggtctcactttgttgcctaggttggtctcaaactcctgggctcaagcagtcctcctgcctcagcctcccaaagtgttgggattacaggcgtgagccaccacttctggtccgaaaacttttttttttttttttaaatagagtcggcggtatgtgataggaagagcagtgaatggggaataactgtgtttagtggttggtcctggctcttatgcataatagccttatgacctaggctgaatgacaatgtctctgagtggttttctactctaaatatagtaactataaagcttatttcacatgactactgaaggatgaaataatatatatgaaatataaattgaaatatagtggcatctactgaaatagggaacatttgaggagaaggagatgtgtggaaaaggagtttggctttggacaattgcatttgagttgtctataaaacttaacctacatgtagagatgtatagcaaacaatgtcatgtagatgtttaaacacatggattttggagtccagagagtggttttaccattgacttagctatagtgacattgagcaggttacttcaacctccctaagtctttgttttctcatctgtaactgagataataataagccattaaagggttactgtaaaaattatagtaataaagtgtacccagtacctgacatataataccaggtaagttttagttattaatatatgaatttggcagtaaaaccttgcactcagatttgtattatcagatgaaaagataattattaaataggtgagagtcattgactgtaagttgtatagctattttagaagtgtggtattcattttgcatggcatattcacaacacattttctagtatttcagctattaatgctaatatttgtcattttttgacattctttttaaaatatgacattaatttagcctctttttgacaatgatagctgtggcttgttccaaatcatctgctttgatttgagaagaagcctatttacatatggtacatttaggtgagtggtaacagagaatactttacctgaaaggcctgtgtccttcagacagagcagagtaggagaaaagctagaaagctgcatattccagtcaccacttaggcagaagtcaggaaactggttgttgaaagcaatagaaagtgaaatgagatgtacgcagggcaatctctgaggttaggtgtgagaggaagggcaggttatgccactaaaaagaggctcttactgacctatatgtttataccctgaaacctaaactttttttcattactctctcccctagttctgctgggttgtgctccagatacagcagagataaagtcctagcatgtcaacttaaaatttgaataagttccatgtaggactatctattgttagaggtagcagttaggttgtagtacaataatattcactttggtgagttactgattttaaaaaattttccaagctaagttgggggacttcaggcaccatgtataaaattgcttattgtggaaaatagataacaatttgacaaattttctaataaacaaaatgatactgccattaaggtcatccttgaaatagttatcaagtacaactggccttccatatctgcggatttcacattcctggattcaaccgacctgcattcgaaatattaaaggaaaacaaagttccatctgtggtgaacatgtataaacttttttttgtcataattccctaaacaatacaatataacaactaataagtaatctaaagatgatttaaagtatacaggaagatagtcatagattacatggaaatactataccttttatatcaaggacttgagcatccacagattttgctctctgcaggagatcctagaaccagtgtcccatggaaaccaagggaccaactatttatttcatttcaaatttattatttatttatttagagacagggtctcactctgccaccgaggctggagttcagtgcacgatcataactcactgcagccttgaactccgagcttgagtgaccctcctgcctcagccttccaagtagctgagactacaggcacataccacaacacccagctaatttttgtattactttatagaggcagggtgtcactgtgtttcccaggcgtgtctcaaacttttagcctcaagcagtcctcccatctctacctcccaaagcgttaggattatagctgtgagccgccgcacctggcctacattttttagagatggaaaataagtgtcacatgatctcattatttctggaggagaatctgaatgtcctcaaaatgtttttttcagacttgaataatcttaaatttaatttttctcttgtagaacttcaaactaggcctgtttagatttaacacataattacctggtcatgttgagaaactgaatgactcagatctctactggaaagaaatctgcttattttgaggaaaaaggaagtcatcaatcactaaatccaagtcttcctcttactgtgctgcctccctgctctaggattagattcattgttatttaccatttcagtacagtgatatcctaactgtacaggtatatcaaaatggaaggacagttataatatcttagaaaattgagaagtaattgactgttagctacctgtccaaaaatggcttcagattaaaaatacttgaaaagtcattttgaattatatactgtctaaaatccctcagtaatttattgtagccaaatgctttatcaaataatttaaaaataaataaaacgaactcatttataaaattggggaaaggaaaaaccctgaataatcttgtcattctaacaggttacagttctgatgtgtttctttattgttctttatcagatatacattttatacattcattcattcatttaacagatatttactgagtgcttattttgtcagaccctatcctaggcattcagagttacagtagttacagtgttgaactgtgtggaacttacattcatgctccatagacaaaacagataaatacttcatatgtcaggaaggtgatatatatgaggaaagaataaggagagcagagaattgctattttatatagagtagttagggaagacatttctgatatggtgacctgaaggaagtgaatgaaatatgaagtatgtagataactgtaaaaaggattttatgaacagaggaagccgttcataaaagtatataagtatataagcctctaggcaggaactttcttgctctattaaggaatagcaaggaggtcattcatcatagagtacatacaattttgtattatttagcaattacatttataaaatacagattcattccaagcaagagaagtttcatgaggtacctcatgcaggaaagggaagcaaagtgatatagcagaaagggcaaatgagtagtaaacatgagacctagttaggggtaaaatgacctgtatcacagaaaattaaagaatcacagttctacactatgagttagataactcataactttgggagaagctgaaaattccatttgctaaaggaaatgattttagaaaactaaacattgttgtctgataaaatttttcctgttaccctgagactttgggtctcagtttccttacacatatttaggcttagattagatatcactaaggtctttttggtaactttctgaaagctttttcttggagcaaacaggaaaggaaggacagttgcctcctgtccccacaataccttcactaacttgcttgtgaactaccttttgaagaacttaaaggctaggtggggtggctcatgcccataatcccagcattttgggaagccaaggtgggtggattgcttgagctcaggagttcaagatcagcctgggcaacatggcaaaaccccatctctaccaaaaatacaaaaaattaacgaggcgtggtggcacacgtgtagtcccagctacttgggaggctgaggtgggaggatggcttgaatgcaggtgcttttgttcagagccttgcattatgttttctgaccttttggctccaggcacatttagtcctaaaatctgttcacacctgtgcaaactgagcattgtatctgaaagaatagctaaaatttatcgataaagatatataatagcggtgtcctgctgactctgtatattgtgtcacctattgagagggtgtatattgtcatttactgagagagtgtgcagtttgaaacaaatgaaaaaagtcaaaagcctttaatcgaactacagacagattctttcctttttaccaaggtggtatcccaaacttggcaattcccgaatttaggaagaagtttgttgagtgtggataaacagaaaggacggaagaccaatgcatttccagtggagacacatacttaattctaaaacctatgtattttcttttttatttttgagatagggtctcactgtgttgcccaggctggaatgctgtagaatgatcacagctcactgcagccttgacctcccgggctcagttgatcctcccatctcagcccccagagtagctggcacataggaatgtgccactgtgcccagctagttttatatttttagtagagacaaggtttcgccatgttgcccaggctgttcttgaactcctgggctcaagtgatccgtctgcttcagccttccagaatgctgggattatgggcatgagccactgtgcctggctagttctaaaatttacatactgtcccttttaataacctgtataaccataacttggatccctacatctgggctttgtccaagtattctctgtatttttatttattttatttaagagggtagagaaggcactgccaaggacagcaggcccgccaggccgctggtctcgccatctgtattttaaaaggagacccaaaaaaggggacctttcctctgttggagatttttttttaagccctataaagcaaagatctgatttcataatgttgtggttagtagcagtcttccagattaaaatatgtttgaaggctgtccaattttttaaaatagaaactatcccaacttctaagaacatgttcttgacatcctctttccttattttcagcgaagaaaaaagccccaactgccttctctggacatcaagtatatgacttcattagagaacgttctaatcttatacgtatttattgtggttaaagtcttttcattcaaattacgcgtatttttgctatacacatactttttaaaaaaatctaaactagaaaatgtaattaaccagaaatttttcagtcttcaagtctgccagttaactgagtgaaatattttcatagttagaaatctgtgctgtccaggccgggcacagtggctcatgtctgtaatcccagcactttgggaggccaaggtgggcagatcacctgaggtcaggagtttgagaccagcctggccaacatggcaaaaccccatctctacaaaaatacaaaaatttgccaggcatgatggcacctgtctgttgtccccacctacttgggaagctgaggcaggagaatcgcttgaacccgggaggcggagtttgcagtgagctgagatcgcaccactgcactccatctcaaaaaaaaaaaaaaaaaaaccctgtccaaaaatggcagttatattctatactgtatttcttactctagtaattgttattgttttctagaagcactttgaaaagaatgctaaaatttgtgattagctgtagccaggaagagttgcggttgatcagtggcatataccaagatttcaaggaaaaagcatagtaaatcctgtgccacgtccctgaactacactcacaattctccaaagaacagtttcaccaaaaatattctattgttttcctttaataatgctttttaaactttggtgaactattttaatgtttctaaaaatatattcaaataatatagtgagcacctgtatactgaccacccagatttatcagatctttacattttgctttatttgattcaggggtttttttcatttgttttggtctcaaactcctgacctcgggtgatctgcccaccttggcctcccaaagtgctgggattacagacatgagccactgtgcccggcctggacagcacagatttctaactatgaaaatatttcactcagttaactggcagacttgaagactgaaaaatttctggttaattacattttctagtttagattttttttaaaaagtatgtgtatagcaaaaatacacgtaatttgaatgaaaagactttaaccacaataaatacgtataagattagaacgttctctaatgaagtcatatacttgatgtccagagaaggcagctggggcttttttcttcgctgaaaataaggaaagaggatgtcaagaacatgttcttagaagttgggatagtttctattttaaaaaattggacagccttcaaacatattttaagaaataacattatagttgaaacttctcattaatcctgtttaatcagaatttttatatacaggtttttaatgttctgctgaggcctcctgattgcctccctgctatagttaattgagaaagcagagccagggtgttaaatattttgacatttgaagtttccttttcaaatttcttatttttaaaaagttaagtgcaacttggtatattcatataaaatgaaaagctttttcatttatttagtgctttaaataatttttcctgaggatataagtgaatgagttgggagaattttaaaaataaaaccatattttgcctacagaaaagttttaagcagtatagttagtcttttagcagttttatgtgtctcatattgttgaaatagatttcttttccatcttttcccaataaagtcatttcaagcagtaaaaataatctaaaatgcttaagcaaactcatgtctgatattttcaagtaattttatgacagaattgtaaacaaaacatcaagagaaatctgattaaaggagtttaggttcaagaaggtgggtaactgtaagttggcttgctagtgtaattagtataagagttgattaacaggtgcacaagacatggttatgtctccaatctaagctcttaagaggttaggttcatatcttttacactgtgcatcccccaccccactatgtaattaaaaattcaggaaattttatcagccaatagaagaaaaaaattaaagtagcattttgtacttagtcagattttttcagacccaagttttatgctagctaataaaactactaatctttagcaagtactggaactaaaaattttttaaatctgtgaaataagaaagttagattatacccttctaaattcccttttagtttatttggttatctacattttatgatttaactatttttacagctagatcattgaaagggggcaaaatccaaacatgcttacagattccattgtttcattggaattttaaaatactgaattataaccagaaaataactggatcattaactggaacttgaagtcttttgtttggataaagaacctttttaagaaaagattttagccttccaaaaatggtccttgtcactttctactataaaattacagtaaatatttctagcattttggttgtccttttgtttaactctgtggttttgggaagtagagactgatagtatcagaaaaaaggctcaaattaagtaaagattctttaagtttctgtttgcagaaattaagtagcatcatactctcctacctttcagttaaatataaaactcaaattccagtttgggggaggctttttagttctaaagattgtaaaatacagattaaaaaatggattcctaaaatggaaactttcaggagaaagatgctttaagttgtaagcaatctaaacgttcagaaggctttctacaggtagtacccattacacaaataattacaatcacagtccaaatccccgaagttctgctgttgcctttgaaaggctttttttttctttttaaacaatctctaagtccagaaataaagcaagcttaaaaagaaaatcactggagcaactgatcttggaatggagtatgcccagagccatctcccttctccactctgcctgaatttttccttttcctttgttacaatttgtgaacgattaatacttttttataaggatcttaaattactttaaaaaccattatttatacgtgagtatgaaccattttgaaaatatggctttgctcagaacacctgagataactgtcccaaaagaatgagagttttgattagggaatatgataaccactttgcaatttgggacacctcggagtatcagatggcctaagggagatacaaaagtagaagagcaaaacccaaggaaactgaagggcaagcattaggaggaatgggtgaaggacacagaagggaaagtgcaacatcaagtatttcaattttttgcctaacaatcactctttccaaagatagtagagcagaaacatcttcctcttctactgtactccctgatttccagctgttgggattcagagctcaagctagtactatttggattaaaaggaagctgtattgtcacccggtaactggactagcctgaggcccttagcagtatctgaacagcactgcctaatggaaatacaatgtataacgcatatgtaattgaaatttttctagtcaaatttttaaaaagtcacaagtaatattaagttttaatagcatatttttaactcaatgtagccaaaatactgtcattttgatgtgtgatcagtataaaaaaattattagtgagatattttacttttcctttcatactaagtcttcaaaatctggtttgtatatttccagtatatctcaattcagactagccacatggtaagtgttcagtaatcagtgtcttgtcattttagacagagcaggtctagatcatagttttagagtggaaatgtttcccgagttctaagtaatagaattttggaacaaagtctaaaaatttatttaacctctctgagtgttggtttccccttctgtaaaaggaggttagactaggagagctataagatttcatccagccccaacattatatgtgtctggggaaatgaacaacagcctttatgaacaatatcctacagaatttcttctttaataattaaactactctatcactgatcagattgacttaagaatatttatgttgtttgaacataagttagtaagtgctaaagctgagattcaaaccaaggtctgtatcacaaagcttgtcttctcttcactccctctcagtcccagaaattttcaccataccaaggttggagataaaatgttgagtctggttatatttaagttagcatcagcttcattattgaatacctcatactgtgtttaactatcatgaggcaggtagttttcctcactttccttttctggaccaccagactttgtattgttactgatctcgtattctgctttgatcagtcccatcgcccatcccttattgagtttcctggtggtttatagtgaagacaggtagaaagtagcattgggataatacatactgactataagttttatgattgtaagatcaagaagcccgagaatctcaggaaaaagtttgcagtgagaatttgacaatgactggggagaaaagaggctcctcttcatctatgtattttacctaatacccaaggtaaagagtgtcttcctaaaagaagaggttgcaaactggtgttgtgtgcaggccaaaggtatgttttcatatgatgtttccccttttttggtagaggagtaaacattttaaaattggcaggtttcacaataaattatagattttctatttcttttgaaaaataagaagacctagtaccactaggtccacattcttcatggagtggccttgctgctccctcgctgagatggggtatggggtattcgaatacagtgtccccaccctcagtcatcatgtactctcccacttctctcattttcatttcctgcaaatgaatttgtgttgttttaaagtgtacataatagactcagcagaattctagtttgcttacttgctgttctgcggacagtcactttaaagcttatgaaaagatactatagtgtactaaatcataaacaattgctaaacagtgtttagagtggtcataaatccctttcaaaggcaaaaggataaatatgtcaataacctcatattatgctttacagtgtgatgtcttatttaatcacttataattccaaacagtaggtagtattatcactttatgtattgagaaaacgaagccagtcttgcagttaacaaagcgtgaagctaagattcaagtcgtaatcttttccaaagctcatgctgttttcactataatgtattgccagaaattgtttgaagtgcttaggttatatacttgatctccaacatatatgaccaatttatagatagtgaaagcattgtcatcctaatatgcattgccatttttatatcatatcagaaaagttagaagcactacatcatgcctttgcttttctacttggtttcttaggctgcttgacacttgatacccaatatggtgttctgagctgtgcctgttcaaaaaggagagcatttttttttcttccttgatactatcactaaccctccccctttgctatacctacactcctttctaagtggtgatagaagcatctattaaatgtcttttttattcagaaagtatttatgatgtacacctctgataaaagatcctggaataaattccaaaggatgagatatctgccttcagaaagtttgtaatcttaaaaactagaggaaaaattatataacaagttgacacttaaaagagtaaactatacaaataaggacaaggaaatacagatcaggatgactgcagaagtagggaatatttacagctggtcattttcttatcaaatttcagctatgctaaaaatcatcaggaagcagagcccactcttagattcagaagtaatgaagacgtacatcatgtgatgttgaaaccatagtgtgggaggccttagcctgttcttagatcaaactctgaggccaactacactgagtaataataataaaaataacttgaacttctcacccataacaagcacaacctttttttttttttttttgagacggagtctcactctgtcgccaggctggagtgcagtggcgtgatctcggctcactgcaacccccgcctcccaggttcaagcaattctcctgcctcagccttccgagtagctgggattacagacatgtaccaccacacccagctaaattttgtatttttagtagagacggggtttcaccgtgttggccaggctggtctcaaactcctgacctcgtgatctgtctgcctcggcctcccaaagtgctgggattacaggcatgagccaccatgcccagcccaagcaaaccttttaatctgactgaagaaatacttgcagacattcaagaagtaattaatctttccttcctcttcatggtttgcatcatataaactactgcattattacatactcttctccttaggtcgtttaagtcattattagagatcctaaggttgtatcagcctctggttgatgatcacattttcagtctggttctaatgctattttcatatcatgccagacaagttggcaagtgctagacatttcccatgtatttgtactaagtctttgtctcccctttagctccttttgtaaccatttcacaatcaccatcaatattattaaacctgttgtatgtaggtcactgggatgctagaggcagggttaagtcggggtggggtttttttggttttttgttttcaaaggactaagaaacaattgcggccgcatgcggtggctcacacaggtaatcccagcactttgggaggctgagggggcgcggatcacttgaagtcggaagtttgagaccaatctggccaacgtggtgaaaccacatgtctactaaaaatgcaaaaatgagccagttgtgatggtgcatgcctgtaatcccagctacttgggaggctgagtggggagaatcacttaaacccgggtggcggaggttgcggtgagccgagctcatgcgactgcactccagcctgggtgacagagcgggactccatctcaaaaaaaaaaaaaaaaaaaaaaaaaaaaaatccatcagttgagtgaagtattttcttttgtaaaagatgtgtaatattgcccaggcatggtggttcacgcctgtaatctcagcactttgagaagctgaggtggttagatcacctgaggtcatgagttcaagatcagcctgaccaacatggtgaaaccccatctctactaaaaatacaaaaaaattagcaaggcatggtggcacatgcctataatcccagctactcgggaggctgaggcaggagaatcacttgaacccgggaggtggaagttacagtgagccaagatggcaccattgcactctagcctgggcaacaagagcgaaactctcttggaaaaaaaaaaaatgtattgatttgattctagacttgtgttttttaacgttttagttttagactgtcgcagatcttataaacacctattggtttatgtaaatataagatacctatgctgccaataaggaaactgtttcttagcactgtcttgaaaatctcagggtattatatttgaaatcttgaggtcatgtttttgttttttattattgcaagatgtgtgtgtgtgtatatatatatgtgcatgccacattttccttattcagttgagtttaggttgtttccacatcttggctattgtgaatagtgctgctgtgaacctgagaatactgatatctcctcaagatcctaatttcagttcttctagaaaatacccagtagtgggattgcagcatcatatggtagttgtgtttttaactttttgaggaaccttcatcctgctttccatagcgactataccattttgcattcctaccagcagtgtacaagggtcccagtttctccacatcctcatcaacacttgccgtcttttttttttttttgagacgcagtcttgctctgtcacccaggctggagtgcagtggcgcgatcttggctcactgcaagctccacctcccaggttcacgccattctcctgcctcagcctcccaagtagctgggactacaggtgcccgccatcatgcctggctaattttttttattttttattttttcatatttgtagtagagacggggtttcaccgtgttagccacgatggtctcaatctcctgacctcatgatctgcccatctcagcctcccaaagtgctggaattacaggcgtgagccaccgcgcccggctgtctttttttattattattattattattattaatagccatccgacaggtataaggtaatatttcattgtgattgtgatctgcatttctctgatgattagtgatgttgaacagttttttgtatacctgttggccatttttatgtctttggagagactacaaaagaaaagatgtccttagtccattttaaaatctgttatttaactattgagttccttatatatttttgagattaaccctttattagatatatggcttgcaaatattttctcccgttctgtaggtggcctttttattgttgattgtttcctggcataagaaaaagttatgccgtttaacatctgtaggttcatccagtagcgtggtagacatggttgttgtctatccaaataatctcactcttcttttcaagtgttagaaaaactgctgtcacaaaattttctttagcatttttctactcagccttcctggacttcttgtagaaatgtgtcaacttagataaattatattttaattatcaaaaaattattctcagttaaggaaatggccattggtttatttttccctacaatgttttagactaggactttatagtatcactttgttttctgtatgctgtgtaatgtagttggccctctgtatccatgggttctacatccacagattcagccaaccatgggttgaaaatatttggggaaaaaaattgtctgttatactgaatatatgcagacttttgtcattattttctaaacaatacaacaactatttacatagcattcacatcatattatgagtaatctagagatgattcaaaatatacaggttatatgtgaatactatgccattttgtatcaggaaattgagcatccatggatttgggtatctgaggaaggtgttcctaaaatcagtcccccgtggatacaggacaactatataacaaaaacaattgtatataatgagactaaaactttgaagtagtcatttttgtcttgtttttattgtatcacgttaataatccacttttgtatgactatacagaaaatacgtatgacttaacttttgtcttgtgtttcaacagaaggagaatatattaaaatgtttatgcgcggtcggccaattaccatgttcattccttccgatgttgacaactatgatgacatcagaacggaactgcctcctgagaagctcaaactggagtgggcgtatccttctctaccatgacagcaaattcatttgctttgtctctagttaacaaatcagttaacgtattctctgtcaaaattgtctttatacaaaaaaaaaaagtaacagctacttaaaaaattaaaaaggaaacatcaggccaggcgcggtggttcacgctggtaatcctagcactttgggaggccgaggcaggcggatcacaaagtcagtagttcaagaccagcctagtcaacattgtgaaaccccatctctactaaagatacaaaaaattagccaggtgtggtggtgcatgcctgtaatcccagctactcgggaggctgaggcaggagaatcacttgaacccgggaggcggaggttgcagtgagccaagatcacgccattggactccagcctgggcgaccggggaaaactctgtctcaaaagaaaaaaaaaaaaaaaggagacattatctctaattctttgctgttagcaatttaaagccatcaaagtttatatctttggaaaggataaacaatattttttgaacatcatggcaagtacttgctagaaaaggcactagactggaactggaagactagtgtttgagttttggccctgccacttactctccgtgaaccttaactttctttacttataaaaggggttaattaataacccatacctcacaggggctgttgtaggaattaaataagaaaacatcagttaagcattttgtaacctcaaattaacaaggctgattctaattcagaattaacttttcagccagacttttttttaaatgactgttaaaggagagctttcctaatttcacctagaaattttcacttcttttagaacctccaagaaactcagtgaaacagaaggagttggtagtttgaactctgttgtctgcctccattctcctgcacttcctcccacgtcccttgaattattcccttcttaggcagatatcagcttggacacactcaccaatcctttcattctgtacaacatatttttaacaaacattctgcctaccaaactgttccttgctattacttatttatcatttaggtccagcataaatatcccttttccagataggccttcttttggtccctcccttctctctctttttctctccatctaaattaggtcctccatttgggctttctcctagcagtcttttttttacccccccacgatttgtaattttatatttggtgatttttttttttctttgccagaggataagctctagagacatagggcctacattttttttgttcagaactgaatgttcaccattatgcctgatacacattaggatttcaatacatatttgtctggtaaatgaggaaactaagatcttaacatactgaaagagtcaggttacgctagggataatggcaggatatgagttttccttttttttggtggaggggtgggggtgggcggcaacagggtctctgtggcccaggctggagtgcagtggcacgatcactgctcactgtagccttgacctgacctcctgggctcaagtgattctcccacctcagactcccaagtagctggaactacaggcacaggccaccatgcctggctaattttttttattttctgtcgagatggggtctcactattgcccgcactactctcaaactcctggactgaagtgatcctcccaccttggcctcctgaagggctaggattacacgtgtgagcactctgcccgtccaggacatgagttttctagttctagttcagtcttcttcattgtaccttcctaattccttaagtatccatgaaaaatctgttaacaacttgaaaactgtgtttatttaaaaccttgactctttttctgttaagatatggttatcgaggaaaggactgtagagctaatgtttaccttcttccgaccgggaaaatagtttatttcattgcatcagtagtagtactatttaattatgaggagagaactcagcgacactacctgggccatacagactgtgtgaaatggttggtatcatttaacattggttcatttttgttctttcaggccctcattttgtattttttaaatttgggttttattgaaagtgatttcttgtggaaagctcagaatgtaaaaatattatgggtcatctgttgaatatattttaaaaagaaaaaaaggactttcggcctccaaaatggtggtgtggtatcagcagcaacaaaacacatcctccataaatcatgattggaacctcttctgctttctcatgtcgtacagtccttctcttctctggtctgtagtgtgaaacatatatgggacagactggacattttcaggtttctgaaagtgattattggttactcgatatttattgaggatttgtcctatgtagataaattttatacttgaagctttattcttttgggaagaaagaaatctagctgaataaggatcataagtatgccgtaggatgtcatactacaaatgtgagaactccttttaaatgcttttaaattattttgttactttttagttaaatgcaattatttattgtttattaatattttccaacttttattttttatttattacccttttccccacttagatccaaggactgactggatgttttccaacatttaaaagcttttatgtctgtactatgctggcacctgtatctttatccagaaaaaaattaatagatgactattataatattatatagatattgaacttttggagttgattaaaatattgccttttacacttgcagaataatgtatgtacaaaactatttactgcagcattgtttgtgatgaagattagaaacagcctaagtatttttcagttggggactactggtgaggttgtagtgtacctataggtcaccatgtagctgtaaagaatgaggaagcactttatgtattaatatgtaaatatccctctgatgtgttcttaagtacaaatatttaagagcaagagaatgttcacagtgtacaaccgttgttgaaagagtctagatatggacataaagatgtctttttcagaaatttgctagtcactcatatacgtgctgtgagtaatttaggcacatatgctacgctacttcccatttctatttaaaaattccttgcctcagtttgacttacaagaatttagcgctaagaactaattaaaagattgaaagcactatgtgtgaagatgctcattgctgttttcttttgttgaaaagtaagaaatggcctaaaagatggaagagttgtcaagtcagcatgtatgaggattatgtagcaaaaggaaaaaatgcttgtactttaatagattaaaattaaacagcacaatattgcatcttcactataataaagtcgtgtgatttgtatgccattgtgcgtggactagaaaggaacttcagcaaatgaaaacagttcgttagcatgccacagttataaatattttctttgaacttagtgtttcattaatctgtgcagcttaacaagtaaaaagtacagctgaaaattcagaaatcttcagatatttgatgattgtttgatttgctgaagaaaacagataaacgtatgttttttaacgattaaaaactgcttatttgaaaaatgtcagtacaaaggtattctgttgtttcatgtttcctgtgtttaaaatcattcttaatactgctttttagccttgctatacatcctgacaaaattaggattgcaactggacagatagctggcgtggataaagatggaagggtgagtggcatagtgttatgccttctgtacctagagacattgctgttagagtggaatctattgtaattttaaccacaactcatttgttttattcttttaaaatttaagtactgaggaatttctagtataagcatggaaaaaacattaggatataagaacactttaaaagacagagtcatactaataaattttgtttttaaaaaataagtgttctcccttaagaagctatttactgtaaaaatgggaaaactgatacgctcgttacattttctttatataaaataacatataaagtaaccagtgtctgcgggaaggtactgcagtttcccttagttgatgaacctgttgattcttatttactttcttaattaattaattaattaattataggggtggaatctcacttcgttgcccaggctgggctcaaactcctgggctcaagtgatcctccagccttggcctcttgagtgagtagctggactacaggtgtgtgccaccatgcccggctaactcttgattttatgtgtgactagaactgatacaacttaaagagttacagttactatttaatattattcagttggtttgtataacaaataccttatttctaaggatcaacagtgactattaatggtgactgagtaacgtatgtatgactatactcatgacattctcaggcttcagtttctttaaagaaaaggagtagaaggtttctactggataacttctaagaccccttccagtttcaaatgctatttaagggctgtttagcagtttattggacattgataaaatgtgttattttctcaggaatgaagattagtaatactaaaagcaaaagtatccggagcagatttgcctggattagaatcctgactccaccttttttttttctttttttctttttttttttgagacggagtcttgctctgtctcccaggctggagtgcagtggcacaatattggctcactgcaacctgtgtctcccaggttcaagcaattcacctgcctcagcctcctgagtagctgtgactacaggcgcgtactaccatgcctggctaattttttatatttttaatagagatgggttttcactcttgttagccaggatggtcttaatctcctgacctcatgatccgcccgcctcggcctcccaaagtgctaggattaccggtgtgggcccccgtgcctggccgactcaaccttttaatagcggtatcactttgggcaagttatttaaatctctgtattccaatttcttcatctgttaaatgataattataatagtgtacctgtagtgcataggattaaatgaattaatatgtgtaatacttagaatagtatgtgtaacatagtaaatacacaagttatttgctgctattttcttattttcacagtataagaaaatacctacttaagattcatttggaggcatgtctaaatctagtaatttattagaagcttatccatccctattacttttttaaatggcattagttctgtgtgctattggtgtttatttgcatccacctgtccagttgctctgctgtcttgtgtttttgcagcctctacaaccccacgtcagagtgtgggattctgttactctatccacactgcagattattggacttggcacttttgagcgtggagtaggatgcctggatttttcaaaagcagtaagtaacaatttttagagaagtaagcaagctgaacaaaaaagcaggaaagaagttaagctcagttttgtgtttatgtggccatgaagtgataatcctgagttgaaaaatgagatgctagctattgctaacatattagctattgctaaatggctagcattttgacctaagtcctaaagtactttggtttagttaggatgcaagatattttactttaattattcttggaattatgctgccttgaggtagagctcccatgtagtagcaggaagtggttagaggaatatatacaaagcatagtacaatttcagacaagcaataggatgcatttttgccttaccttgaatcatagaaaagatctattttattttaaaaattcacagcaaacttggccagttctgtacaaatattggcttttcttgatgtcatatttgagcagcagaaacaatcagacctttgtatttcctgaagtcctgaattatcttggttttgaattgatgacaacatgggtttaaaattttccccagcagtcctttctaagtgttgaggctttattctaagggtaaaataagacaagatcttactcatttaaacattctggttttttcttgaattgtatgtaattatgattataaagtatacagtcaaccttctatattttaggatacatacttttttagtttcaaagataaatacccctgtagattttatgtgacctcagttatatattcatattatctcttcagttcttagccattggcaactgtattctggattatgggagttttgtgggacatggaggaaaggacacttttagagcagaaagataaattttagtgaatttaggaactttgctagcttgaaggcactgaatgtcaagggtccaacaagtcaggaattgggagaaggacatttagaaaaggagataagaggtcataaaggcaatacttttgctactttattttctcccataaatctctatagcaggaactgttgtcaggttgttgataaccattgttacggtgttaagaccatcttgaattgcctcataactctatcttttctaattcagataatattccaatttaggctaagagataaagaggagaagagagtaagctctgcccttcctcagtgcctctcactcttcactacaatgtttctctgttccataacattgtaaagcatatttcacaaatgatactatttttaaaaagcatttaatatcatctataggtatttttcttaaactggaatacttaaaatacgtgaatgagaatggtttcagaaaaacaggaaatttcattataaaaaaggaatttcattataattttacttaggttgtttattcaagttaatgtaagtcaggtatctcacagaaaactgaaatcagcaaactctaaaatagccatgaattttagcttattctgtcaaactgtcaaaatttagtgaggaacaaagttatgaaattgtgtacatttcttcttacctaccacaaggaaaaatagcttaatacaggcagcaagaaggaagcataagatgcagaagggactaggatagcctcaaaattagtcactatctctgaataataggagtgactagatggcaagtggaaataacctggagggatgaggggatttaaatagaatattttgtaaaagaatctttatatttttgaggaaaatacaattgtagtaaatagtgtattcattatgtttcagagagcgatgagtttaaaggattttgggttatcttactatttgcagttttaataagatggtatttctttcttagaatgttagccctatcagtgaattttaaaatgcctctgattgacttttctttaggattcaggtgttcatttatgtattattgatgactccaatgagcatatgcttactgtatgggactggcagaagaaagcaaaaggagcagaaataaaggtaaatttttaaaaaaccgagtattgtgttttagagtacgttacttgttttgcaggtatttggaactatattggtattagaactatctattcgtaagtcgcaaaagcagatctactagccaaattcagcaaatttagtgatttgtcataatcgttaagatattaacactatagttatacaagataaaatagtcaagcaacttgaagcaatttcaatatttcagacattactatagtcctgaaatgccagagtagatggatgtgtgatctcataattaagactgaacacacttcttggttttcttctttaataaaacatgtaatttcattccatctttaaagctttagaaatctagaggaaaaattcagtaggaatacgactgatgtaactgaagggcttatgttaagttttttggtcttaattgtgtttgtaggattattttagaaaattcaatagcatttataattgctataattgcattataactctttacagtacaagggttgatctctgtgtagatcaagctgtacgttgtaagagaagaatgtaaaatgcattgaagctgggtttatatgagccagaaatggacttctccctctgacaggcatttaaaaagattcaaagtgatagaatggctttaaaaagtctgtgtaatatttgccatactcttaaataacatcacattactctccaactcctctcttaacagttttgttttgagtaagcttcaagcttttagcttgttgggcagaaagatgatgtgatgtttaacttaacattttgaaagaagtagatttgattgtacttaaaaggaatataagttgtcagaaaacctcaaactttaaaaaacataaatgaagatatagattgacttccagttattcagagtaatttaacattgaaacatagggaagttgcatgaaaatgaaatatatcaattttgattcttcatagtaaggtttaccagatgaagtcttgtggttttcctcctactggcgatttctcgatctcctttccaggactttaaatgttggtgttcttcagagttttattccacatgctccactgatactatatgctgctcccatggcctcattttctatctgctgagtcccgtatcagttatctccagcccagatctctaacaggtttaactcatatttctagttgcatcctagacatctttatttgaatgtcctctaccacaaatgaaaatcaccatgttcaaatctgtacataatcatctttcctagcccccaaccaccagtttcatcccttagtgattgactccgcatttcacctagctacctaagctagaaacttggacatcattcatggctctttttacctcacttctcacatccaggtagtcaggaagttctctaaacaccgtgtcccaaatatctgcattatagcactttctagtacaagcgactgcaaaacaattgaaattaacttaatctggccaggggtagtcactcacacctgtaatctcagcactttgggagaccaaagtgggtagatcattagatgtcaggagttcaagaccaccccggccaacatcgtgaagccccatctctactaaaaatacaaaaaaaaaaaaaaaaaaaaaaaaatagccgggtatggtggcagttgcttgtaaccccagctaccctggaggctgaggcaggagaattgcttgaaccctggaggcagaggttgcagtgacccgagatcacgccattgcactccagcctgggcgacagagcaagacttcgtctcaaaaaataataaaaataaagttaacttaatcaaaacagaggatgtattgactcctgtttagggaggaagagaaaacctctagtaaaggtcagagggagattttgactcagaaatgacttgattcaggggccggattacgggttgactgtctctcctcttctccctgtcttgaccttattctgttctactatagatgagctccatccttgcttaagtcacaaggatttggggagttgatatataactttttaatttatgtaaatttaaaattcagtaaggcgagggcagcccagatgacccgagcttgtgggacctctcatgaaaaaaaataaaaaattaacattaaaattcagtaagggcctgggtgctgtggctcacgcctataatccgagtactttgggaggccaaggcaggaggatcacttgagtccaggagttcgagaccagcctgggcaaacataatgagaccttgtctctaccaaaaaaaaaaaaaaaaaatagcagggtatggtggtgcacatttgtagttccagctatttgggaggctgaggtggaagcatcaattgagcccaggagattgaggctgcagtgagctgagattgtgccactgcactgcagccaggggaacagagcgagaccctgtctcaaaaaaattttttttaattttcaaaataaaaataaaattcagtaaggcaacttaaaaaccttactgacagaaattaaagaggagggatgttacataatcatggataggagacgatgaagacgtcacttttgcatattgagctatatatacatttagcagagtcaaaactcagctttcataggagttgacaaactgaatatatgtggaaatatgaaggggaagaaatagggaatagccacaattgtaaagaaaaagaataaggtcaaagcacataaaatataaaatatcaagacttatgtaattaagacattgtgatacaaacatagatcagtggaagagaatatagaaacaggttacacaaatcagttgcttgacttatgccaaaggtggcgatgcagtaggcgcagaataatgttttcagtgaatggtgctggcttaattggatactcatatgaaaaaaaaattaccttgacccctccctcacagcattcagaaaaatcagttttagatggattatgcatcttagcatgaaaggtaaaaaacagtaaagcttttagaagaaaatacagaacacctttataagtagatttcttaaggcatataaagtactaaccataatgggagaaaaagataaatcatgttaaaaacttctctttatcaagacaccttttttttttttttttttttttgagacagtctcattctgtcacccatgctggagtgcagtggcatgatcttggctcactgctgcagcctccgcctcctgggttcaagtgattcttccgcctcagcttcctgagtagttgggattacaggcgtgtgccaccatgcccagctaatttttgtatttttttaatagagtcagagtttcaccatgttggccaggctggtctcaaactcctgatctcaagtgatcctcccatctcagcctcccaaagtgctgggattacaggtgtgagccaccacgccccgcctatcaagacacctttaagagtgtgagaaaatatttgtgatacatacttccaacaaaacactcatattctgaatatataagcatctatagttcagtaagaaaaagacagttttttaaacagcaaaagacttccggcactacataaaacagggtgtccaggtgattaataagcatatgtaaaggtacacaacctcattaattatcaaagaaattcaaattaaaacccaagtgcaataccactatgcacctaccaaaatatcttacgtgaaaaagacaaaaatactaaggttgctgaggaggcaaagtaactggaactctcacacagtgctgctgggcatgtaagttgataatagccatattatctcttcagttcttaggcgttggcaactgtattctgaattataggagttttgtgggacatggaggaaaggacacttttagagcagaaagataaattttagtgtatttaggaactttgtgaattgttccttagtgaatttaggaacaatttagtgaatttcagaaaactatttgacataacctaaagtcgaacatatgcatgctttctggcccaaattgttcatctcggcagaaatatatacatgtgtttgctagaaggcaaatagcagtgctgtttatggtagccaaaaacatggaaactaccctgcccatcagcaggagaatggttaagtcaataatgtgatattttcatacaaaagattacaatagagcaaatagaatgaacaaggtacacctatatgcaccaacacaaatggattttagaaatgaaatgttgacaaaataacccagacatgaaggaatgcattgtgtataattccatttgaatgaaacggagaaaaataatctttgctgctaagagtcaggatgatggttaaatagaggaaggggatagtgactggaaaggggatctagggtatttatggaaggttagtaatgttttgtttcttgttctgaatgctgaatagcgatgttttcaatttataaaactttattgagctatgtacttaaaatctgtgtgcatatatatatgtatataaaatatatatcaataaaaagttaaaaggatatatcctgtaaggcaatactcatacgcaaagtgatttaaactcatagatttcttcagtttatatcttgactgtcttatcactagcatgatgggtatgctgggaatatttgtagttagttttacaaccctttgattatcttaatttggcctaagatttaactgtcatgtagttttgatttgtctgagtgaaaactaaagactgttcagtcaatctttaaactttacttagacttgctaaatatgtatatagttctatactactgcatcactgtggaaaattacgtaacaagcaagatgtgctgtactttatcttcaacttttttttttttctttttttggtcagggtctcacgcgtcacccaggctggagtgcagtggcttaatcacagctcactgcaacctcaaactcctgggctcaaatgaatcctccagcctcagcctcccaagtagctaaaactacagcgcgcaccgccacgccggctaatttactttttgtagagacaggtctcactatgttgcacagttgatctctaactcctggcctcagcagtcctcccaccttggccacccaaagcattgagattacaggcataagccacaacacctggcctagattagattttattagttgaattttatttatgtgcttatgcaaaggcccttaagcccaaatgttaagtaacagaaatgtaaaactcatggaaatattggaactgtgagggaaaaaaaagaatttacaacaaccgtttcaagtgtcatttaattagtataacataaaatttattatttttaactcggttcataagactatcatctttatcttggttttgtttcgttttgagacagagtttcactctgtcacccaggctggagcgcagtggtgcaatctcagctcactgcagtctctgcctcccgggttcaagcaattctctgcctcagcctcccaagtagctgggataaaggcgcccaccaccacgcccagctacttttttgtatttttagtagagacggggtttcaccatcttggccaggctgatcttgaactcctgacgtcgtgatccacccgcctcagcctcccaaaatgttgggattacaggcgtgagccaccacgcccggcccatgttgttttgccaaaaggaaatgcttccgtacacgtaaagttctttgctaagttaaaaagtagacattaatgatcaccctgtaaataaacactagctaataataaggagctttacaggcatgtagttaagtttcacctcagtgttaagtttgagtagatgattttactataaaatatcaatttagtgagaattatgatttactgaaattatagaaatacactgttttagaatgatatcctcaattgaaatcattttaatgaaaaaactagtaatttcttcttgagtctcatgcttgtattcttcctagtccaccataaatcttttaaacttaatgcctgtctttgctagattttttgagggaaaagagcataaaagccctctgggaatgtttttgttttaatttctgtaggaatcagtagtgaccattctaaatctactttttaagggttcagcctgaaggacatatctctaaattagtcctaatctctaaacattttgttgaggctgggcgcaatggctcatgcctgtaatcccagccctttgggaggctgaggtgggcggatgacttgaggtcaggagttcgagcccagcctagccaacatggtgaaaccatgtctctattgaaaatacaaaacttagctgggcatggtggtgggcgcctgtggtcccagctactggggaggctaaggcaggagaaccacttgaactccggaggcagaggttgccgtgagccaagatcactccatttgcactctagcctgggtgacagagcaagactgtgtcttaaaaaaaaaaaaaattgttgcgtgaatgaatgctccataataatagtacaaagaaagataagactttcttttctttctttcaatacaaatagcagtgtctttaagaaagaatgtacattgctcttaaattcgacagttttaagtgtacttttctggcatgtgcaagaagttaaaggtattcatataagtgtctttctaatgcagcgtttttataaatagcataaaaggtgatacgataatacaaggacatcaaatttaaatcatcccaaaaaatacattatcaaaatttttcaggaaaattgtcttagaagaagaggcattttctcaaaatcttgccctatcgttaattgtaagtagcagtaattgaattgatacttgaaggagataaggatatacattcatctaaagctttatttcccttttcatagacaacaaatgaagttgttttggctgtggagtttcacccaacagatgcaaataccataattacatgcggtaaatctcatattttcttctggacctggagcggcaattcactaacaagaaaacagggaatttttggggtaagaatcagattgttttaatgtcattaggtgtataagactttaatttttttaattgtttaataagcatcaagttgtcatggcaaaaagaaaactgaaaatttttattgtttccttgtagaaatatgaaaagccaaaatttgtgcagtgtttagcattcttggggaatggagatgttcttactggagactcaggtggagtcatgcttatatggagcaaaactactgtagagcccacacctgggaaaggacctaaaggtacagtattcttatattaaactcatttctggtaattctcacatagtactctttcagtcccatctcttagaccaggagagaaagagctgcagtgtaacaatatgagcaagtcaccaacataccttttgttttcagcattcttcataatctttttttaatgaaattatttatccagttatttattaagcttatataacccacatttgactatactgaaccattccctttaggaagttaataattagaaagaaatgatatggatatatgttagtttaaaaagtataaaggctcactttcccctgagctggttctgggatatctgttagagcagaatgcatggccatgtgataaaatggaagagtggagagaaaaggaataaactcatagttcaatccacttctcctttttcttttcctcactgcagcccttcttcccaaccttagtgtaggggtccttggcatccattcagctttacctcaaatcagttttcctaaaaaacacagatttattcttaagttttatttgcacccaaatatacaggtcctctttgcccttttctacggtaaatgaaaaaattagaggaaggacatggaaaataaccttttttaaaccccatttttcgttactatttaagaataatcaaactttgaaaaaaatgtccagagtaccatgtacttccttcagagtaggaggttctaagagaaaaattggagacctggttctaaaaccagtgggccaggagaagagagagattcttagcagcaacaggtggtaacagtagaaatagaactagctaggtcagccagtcctcaataattcaccaaaaaaaaagtaagaaaggaggtaatggggaaatcaccctgagttttctgagacatttcccctggggattggcagggcaacatgtcctttctcttgttcattcacctcccctaaacacactggaacaacaccttatacttctctctctctctctctctctggagtccttgcatcagaccatgaaaatcaccctaagtgatttatgaataagggaatccctgttcgtgtgctcagaaagacccgatttacatatctgccttccccaataagctttccctgggctagcacagtgtctggcatttgctattagctgtttgaaaactatttgtcaaacattaaggaaataactttcatcttaactttgggtgtcaatgtaggagtaaaagttgagtagtattgatgaaagcactgttttcaccgaaatgtggaatttaaatttcgcattactgttttcttatgactgcacagagtttcatactgtattttttaggacagatattcagatgctccttgacttctggatggcattatatcccgataaatctatcataatgtcaaaaaataataaattgaaccaacataagttaggcactatctgtacgaaattaatgttttaattaaatgtttttcaaatccattcacctgaatgtctaagcttggcagttgaattagacctattaagaagtttaaaacaagaagccttaaattgtattaccattgactcctatctcaatcattggccatatattcttagcctctttcgttcagtttaggttcaaaatttacacacgagaagaatggcagtgggttgagggttcttaaaaaatagagttacaacaacaatatattatcaactacttttcccatttatttctcttttctttttttcttatttttctttcctgggcacatttacttagtatcagaaatgccaggaacagcatagtctattaaaacagtgacttttaaattgttcacgaatctccaacactgagcagaatttgcgtataaatatacccttttgttagccttaatatttgtgttcaggttggggacaggaagaagaggttcagaggtttttattttggtctttgaaaaatttgtggctcaacctctctacatatgcacaaacaggaaacaggaaatccaatcttgtaaattgctgggcacatgaaatggcctgtgttgtactttgccacatgactaaccctattatgggcaaagttgctaagaatttgaggttttcaattggctgggaagaatttggtgagcgcagtgaaataaatggaagtccagaccagagtaagtgtccacagtttccattttttaattctggcccccagatttcagtagatccaatttacatattcccaactatgacatttctgcacctgtggcagtcttaccaaccaaaatttgagtgtactgtgacatcctgtctgataaaaggagattttttggatggcagaagtataatttcacaactaatccttttacttttgtaataggagacaaaccaaaactgtattttatgtcttaaaagtgcttttatatatttttttcttgtttccaaaccatttcttccttaaacatgaattaatgtgaatcttcaaagtaattagtgttttctgtttcttaagtaggtatgaggtatttgttatttatttcctacacatatgaaatagattgaaattgttcttatgcaaaataatttgtaatcttttaagtgggtaagtggaagttgagagtatctacagaaccattaaaatgttcaccattcttaagtcttgcaaaggagctaagaaacactgccattttatgtgttctccgaataatcaaatgggcccagttgctaagaatacaacataaatttcaaagtctccctaatattttattctttaaacaggcacagaaagccttccaaacatctttatttggcaggcagtgtaaacttgctttttatggaagctttgtgtctgttagagatgagaagaaagggtgaggtttgtgattaagtttggatggacttgaccatatgagtaagcctgaaggcagagtaggtttttttaattcaaggataattattttccttggcagggatttcaaacattatttggcaactgaaatatcagaaatacaggcccataagaaagacatctttggctataaatttgttttacaggtaaatactatataaaggaaactttgataatttgtttaaattagaaacactaaattttttaagctaagtcgatactaggtccacctcaggaaataactttcctggagtgagaaggactcactgacttgatcactatatagagtatttttatttctgatgaagcatttttttcttcatttttttttccagttttccatcattctgggaggattttaagtgtttaacaaggtttttgtcatgtttagaaatacggaaagcagacttaagcatagaaaagctttattttcttacattctgatagagaactatgaaactcccacacctttgctttttgtgttttcttacatgataccttcaggctactcttgttagtttgaccatgcacagggaaataagcctagaatttgcttttctctatttttattatccaaataaagccagtagtactctcagaaaattctcatctctcaggtgtcctccctctcgtggtaacatcagaacagagatagatacttatctacctatgccagtgaacacagttgtgttgttcaatttttaaggtatttttagatgataaatattgatgtaagtggagacagttgacctgaacagcaagtttgttggagttctacttccagctctgctgaattgggcaagttctcctccaaatcaagcaagccctttcctgtctccctgccatatatacccatctgttaagtatttgtaccactagcatactcaaactgagacataattttttttaggataccaaagccttagaaattttagtcaatttgttaagtataatagcagctcaaatagatgagtaaaaaagaacaatctcagtaacaacttcgatatataattcacataccatgaaatctaccctgttgaagtatgcctttaagttcagtggtttttagtatatttacaaggttgtgcagccatcaccactatctgacctaaggacattttcatcaccccaaaaagaaagcctgtacccattagtagtcactttctatttctccctcccctcagcccctaggtaaccaccaatttcctttaggtctctatagatttacttgttgatgacatttcatataaatggagtcatacaatgtgtggtcttttatgacttgcttctttcacttagttttttttgttttgttttgtttgtttgttttttgagatggagtttcactcttgttgcccaggctggagtgcagtggtgcgatttcggctcactgaacctccgcctcccaggttcaagcgattctcctgcctcagcctcccaagtagctgggattacaggcatgtgccatcatgcccggctaattttgtgtttttagtagagagggttttgccatgttggccaggttggtttcaaacatctgacctcaggtgatccacccacctcggcctcccaaagtgctgggattacaggtgtgagccacagtgcccagccttcacttagcattatgtttttaagattcatccatgtggtggtagcatgtgtcaatacctcattcctttttatggctgagtaatatcacattgtatagacatactgtgtttttaaaatctattcatcagttgaggaacagttttagaaaatgaatagttgttaaacctgaattttttcaagaggactaagggctgtttattgacttactttggccatatttcaataaggttctaccttcccattttgaacctggtaactaattctgtaggacatcatcttccaaaaagctttactcttgctctgctagcctatctagctaaagagcttctctgagtaaggcatttatgaataccaaagaaaaaggtatgagtactatcatcttattctcacccttaaaagggggcaaaatataatttaaaaaaccacatgtgtttgcctaaaagaccttttatgtacccccttggtctctccctgggtacttaacaaagtgtgctatgggtatacaagaaaactgggctgttatttagccatcacattggtacagctgaatcaatttttaaaatactgaaattattctctgctagtaggtcaaaagccatcactgcaggtatccattgcctacctttgtcccaataacttctgtagtgcccccatatctcagcaaataaaggggagtaatccttggcacagcagaaggcctctgggttaacaatggttgtaaaacgttaaacgttgtgactgttacctcagaaggtcaaccaaagatgtttttgcaaagttaaaggaacatcaaggtgggagacttgagcctagtcacagctttgttattagctaactatgtggtatcccctaagctgctcctgtacctcttgtgtcttgagctctcatatcagaagagtgacacctaccctagctaccatacaagatgattatgagagatagtaaagttctgaaacctatactatatcccctttcgtctgtggaattatcactacttttgctttggttttttgtaggaaaatattttgaaatattttcagagtaaataaatattgacagaaatgcaaaagattgtattataccctaaactttactacctgctttgcacaaaagacttgctgaaaataggtttttgattgagtcatatgaactttctgattattaactctagttctactgaagttttcttccaaatagacactaaaatctgaagaaaagtattatcactagtgtttttatttttccctcatattaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggtaaggatggaaacggaatataaaaatattaaatactctaaactcaggtattttgtcccacattaagataacttatacttttctggcaaacttattaaattcttataatttcatttcctttcctcaagaaaggagtttgttgttgcctttaagataacttttttcaaaaaaaaaagaccattaaaataatttgaaagactatttttaaagattaggcagaataatttgcctgttaaaaccagagcaaatgtcacaaagtttaatttttcttctcttttttggtgatttatattttggatttatgcttagtgtttttttttctacgtgtagcattctttccagagaaaatcttctggaaaatcctcttaaaaagaggatcctgatagtactgctcttggattttatttccaggaagatagataataaagagttgcttaatcacaaccttcagttcatactgaaaatgcaacttccatcactgttttcttcacagataactcatatcctttgttaataaaagctatacaatctagttcactccttcctttcccatttctaatgtaaatttggattcctcttagagttcagttatttgtatttttaggagtaattttagatcccacttgataaagtgggatttataattccattatttcagaatcattctttgagattattattaaatgtattaacacagcattcactgagattgttccatgtattgcattaaatgaaattgctctcccaaggaatcctattattataatactttataatatattgttttttaatttacagagaacttccacattacatttttttaattgacacattgtaattgaacatatttatgggatacaatctgatgttttgatgcagatatgctgtatagtaatccagtcagggtagttagtatgtctgttgcctcatgcatttatcatttttttgtggtgagaatatttttatattttgatccttacaacaatcaagagtgggtagggcatgtattattatccttatattacagaaaatgtttcttaggctaagtaacttacccaaagtaatgtaactaatataactaataagtaacaaaacccgaccacattcttcatgtgatttcatgtgagctaatagaacttacttctttttttttttttttgagacagagtcttgctctgtcgcccaggctggaatacagtggcccagtcttggctaactgcaacctctgcctcccggattcaagcaattctcctgcctcagcctcctcagtagctgggattataggcgcccgccaccgcacctggctgatttttatatttttagtagagacagggtttcaccatgttggccaggctggtctcgaactcctgacctcaggtgatccacccgcattggcctccaaatgtgctgggattacaggtgtgagccaccatgcccagccttttttccctgttcttaacccttaactcctaaagtcatataaaatatacgtttaaaattaactgaagcaaagaatgttgataattattataacttctgtataataaaatgtcattggacaaataaattagtagtagtatgagattaccatatccaaatttgggctttcgtcataattacctcataattgcttacagctataaatgcaggcttcgagtagtaattaatgcatattagtatgtatatggtgactttacacttttttttctaggttcctgatcagtatggcacaatcagagctgtagcagaaggaaaggcagatcaatttttagtaggcacatcacgaaactttattttacgaggaacatttaatgatggcttccaaatagaagtacaggtaagctgtgtgatattaaccgttaactgaatattttttatgatattctttggttcttataacaatgagtgtctttcattttcagggtcatacagatgagctttggggtcttgccacacatcccttcaaagatttgctcttgacatgtgctcaggacaggcaggtgtgcctgtggaactcaatggaacacaggctggaatggaccaggctggtagatgtgagtgaagcaggatgtgattattaacctccccacagaaactcctcacactggcagttgagagcagcaaagtaaaaaggactaagtgttgattcaaaccaaatgtaaacatatggtttagtaatagagggtggagataagagggtagcgtttagtcttaaagtgtgaacatgaaccgattttaaagaagtaagttaggccgggcaaggtggctcacacctgtaatcccagcactttgggaggcccaggcaggcggatcacgaggtcaggagatcgagaccatcctggctaacacggtgaagccctgtctctagtaaaaatacaaaaaattagccaggcgtggtggtgggcgcctgtagtcccagctactcgagaggctgaggcaggagaatggcatgaacccgggaggcggagcttgcagtgagccgagatcgtgccagtgcactccagcctgggcaacagagcgagactccgtctcaaaaaataaaaaatagaagaagtaagttagcagcgtaaaagctcaatttgtccatcagcttcagtagtaaaatcataaagatttcaaatatctacatagcattaattattatggaaacatttgtgcctcgggtggcattgcagttggattcagtaagtgctgctcactaacaggctctactgtcttctttctgggtggtctcttactgtattttctctctacccaacccagatatccaccttctctagcccaagaggtgtatataagttctttgtggatgctaaagaactgtaccagtgtttgttgttattatccttattattgttccactccctagccacaagctggttgtccctttccctcaccactctgccagcatatccccttcatgctctgaaattctttttcctctcatatctgtgtggtatttctcattagctacaaagttgattgaaatgttatgtttgaatgaaacaggttattttcagaagtttttgctactgtccccatagggagactttctcatgtactccccaacagctgtctgtctcttttctaggaaccaggacactgtgcagattttcatccaagtggcacagtggtggccataggaacgcactcaggcaggtagggtctttaagtgaactgagtaatctgaagtggtgggatgtttaaatgctattcaggaatgttctcaatctgatctggagaattaatctcttaagtggcacactaatatgcttgttgttcttatccgttttgtatattcatagaattcaattatttattgagcacctgccttttgcgacatgctacatgctattgtgtgtattcagaatacatcagaaaacaaaacaaaaattcctgtcctgtgaagcctacattttagcgtgtatgggacagaataaaaaataagccctgacgcagccaggcacagtaatcccagcactttgggaggccaaggtgggcggatcacctgaggtcaggagttcgaaaccagcctggccaatgtagcgaaaccccgtccctactaaaaatacaaaaattagccaggcgcagtggcacacacctgtaatcccagctattctggaggctgaggcaggagaatcagttgaacctgggagacagttgcagtgagccgagattgtgccactgcgctccagcatgggcaacagagcaagactccatctcaaaaaaaataataaggcgagttgcagtagcccacgccagtaattccagtgctttgggaggctgaggcaggaagattgcttgaggccaggagtttgagaccagcctgggtgagacaccatctctacaaaaaataaaaataataaacattatcacgaattatattagaaaatgttaagaaccatgtgaggatagggaaaatgatgggagattaagagggagtgcagttgcaaaatgatagagtggtcattatgggcttcattgaaaaggagttgcagatttgacttttcctttgtgaaatgagaagaatcagaaaatttctctcctcatcttttatgcaggggaaggatttgaagctgatgtaacaccattgagcatttataagttgtttgtgctataccttttgccatcctgtcttttttaaatgctacgcagatatataataaagatatattttctaaaataatttaagacctgtcttgcagaccttgtatagtacctaaggttaacatgtttatgatttatatatctttaattgactcaactttattgcctctgctagtaagtagtccttctcacattttttaaggagacaaaaacatgaagtcaattttcccaaaattaaactcattaaaaaatgtggaatgctgatttttaatggggtgagactattgtgaacatgcttatgtaaatatttttgtttctatataagacttaaatactttaaaccaactaattcatttaattctaactaaatttagtcatttagagggggtttttttatagcgatttttccttctggctgttagatacaaattaacacctgaaatgtgaaaacattccaatttcttcttacatatagtgctgcagaatctttcagaataatggaaaaataggtctttaaagataattgaattatgaatgtgaaactagagatgctattgagtgaaatcattgaatttttagaattaggctgcttgagagagcatttggtgatactttgcaaatatagaaggctagctcagatcttccccaaaacacgtaagtaatagatcatgatgaggtttaaaagcacttagacttggacatttgtccatttggaccgagtttggtccattctctttgagaaagacacatgacaggtaactgtaggatttggaggaaattattttcttcaaccaaaaaaaatggttaagcacacaggaaaccatctgaggtgtagtgctgatccagttttcagaaaaccacaaaggaattcacttcagatctttatttttggcagctaaacagatatcacaaatgctaaagtccttgaaataataaaagtaagagatatcatttattcagtgtctgatgaccttgtgctaaatccttttttttttttttttttttttttttgagatagagtctcgctctgtcacccaagctggagtgcaatggcatgatcttggctcacagcaagttccgcctcctgggttcacgccattctcctgcctcagcctccaaagtagctgggactacaggcgccctgccaccacgcctggctaatttttttttttttttgtatttttagtagagacagagtttcaccgtgttagccaggatggtctcaatctgacctcgtgatcctcccgcctcggcctcccaaagtgctaggattacaggtgtgagccaccgcacctggccgctaaattctttttatatgttactcttcacaagaatgtaacatagtgtttattaatatcgtgattgcacagacaggaaaccaagacccatagagttctgttacctgtgattgagctcaggttctgcatggttccaaagcttgtcctttcctctaatccaacagtactctttgagatatttacagcattaattagaaatattgttaggaaggtttatctttgacaattaaatcactgattgacattgttaaagcatactatgtatacaagggagttaaacactaaatgggcgattgtaaggctagcggggtttgaatcatgaagataaactgctttggttgaagaaaacactgtgtgtttacaaatagacatacacggccccaatttgtagggaaaattgttctgaaaaactcactgaaattactttccagcatttacatagctgtgaagtcatcattgacaagcttaaaatggaaagtcactcaattttagtgacttaaactaaaggtaagccaattggtttctcttggagttgtaagtagaaaacacttcatgagagtgatgtgataactaaattgaaagtgctggcagtccatttggggattgattagaatctaggggagatgtagttgtcagtgttcattctgtatgtaactcctgtctttggtttcagatctggttaggttctgttgatccttggggaactttctcatttgtttttatttttgccttggatctatgaatacctgaatgtattgtctaaaatggaaaaatcttaatgtagccattctattactatcactgaccctaggcctgaaaaaagtcacacctagggttaagaaatttttattttattttattttatttacttatttagagacagtttccctcttttgcccaggctggagtgcaatggcatgatcccagttcactgtaacctctgcctcccaggctcaagcgattctttagcctcaagcctcctgagtagctgggattacaggcgcccaccaccatacccagctaatttttgtatttctagtagagacagggtttcgccatgttggccaggctggtctggaacccctggcctcaagtgatcaccttgcctgggcctcccagagtactgggattacaggcgtgagccaccacgcccagccaaggacatttttctagtagaatgcaacacatgtccaagttgtgcatgatccaaaaaaagtgactagtaaaaaaaagtaatgatgtcttcatgtccagatctagatatcttctacttcatgtaactaaagagtaagcacagtgtgaataaagcatcaaataagtacaattatcattttaaaataatgtcttattaatgtaattttaagagaaaaaaattaaacatataaccttaagtggacatagtacttccttaacacgttaatgctgcagggcacagtggctcatgcctgtaatcccatcactttgggaggaggccaaggcaggtggattgcttgagcccaggagtttgaaaccagcctgggcaacatggcaaaaccctgtctttacaagaaaaattttaaaattagccaggcgtggtggtgtgtgcacctgtagtccctgctactcgggaggctgaggcaggaggattgctttatcccaggaggcagaggttgcaatgaactgagatcacgccattgcacaccagcctgggcactgtctcaaaacaaaaaacaaaagttaatgctcacatagaaaggattctttttaacaactttgttgagatataattcacataacccccccaaaaaagaaataaaaaataattcaaatactataaaattcactgatttaagatatataattcagtaagttcacagggttatgcagctatcctcacagtctaatttcagaacaatttttaacccagaaaggaatcctgtacccattaatagtcattccccatgaccccacccacctccccccttactctaggcaactgacccactttctgtttttataggttgtctgttctgggcattttctataaatggaatgaatcatataacgtgaagttttgtgatgagcttctttcacttaatgttttcaaggtttatccacgttaagtacttcatatatagcatgtattatggccaaataacattccattttatggatataccaccttcatcaactgatggacataggggttatttccactttttggctactatgaataatgctgctacatacattcatacatgagctttagagtggatatgtgttttcagctctctgggatataaaagagtagaattgttgggttaaaactccatgtttaacattttaagaccaggcacaatggctcacacctgtaatccccacactttgggaggctgaagcaggaggatcacttgagcctaggagtttgagaccaacctgggcaatatagcaagaccttgcctctacaaaaaataaaaaaaaaaatagccaggcatggtggcacatgcctgtggtcccagctactcaggagcctgaggtgggaggataatttgaatctgggatgtcaaggctatcatagtgagctatgatggcaccactgcactccagcctggatgacagagcgagaccctttctcaaaaccaaaacaaccaccacaaaaaaaaaaaaaaaatttttttttttttgtttaggaactaccaaactttttcacagcagccgtattgtcttatgattctaccagcaatgtatgagggtttcagtttctccacatccttgccagtacatattatctgtgttttgagtatagccatcctagtgggtgtgaagtagtttttcattatgcttttgatttgcatttctctgatggctaatgatgttgagcatttcttcaagtacttattggccacttgtatatcctctttagagaaatgtatgttgaaatcctgtgcccatctttgaattgggttgtctgttcttgtaagagttttttatatattctggatacagttccttacagatctttttcaaatattttcctcattctgagggtggtcttttcactttcttgatgttgttaatagcaccagagttttaagttttgatgtagtttagtttatctgttctttctcttgtttcttaagcataaatatttacttctatgttttcttctaagagttttatagttttagctcttacctttaggtctccaattcgtcttgagttaatcttcatatatagtatggcccagtaggtgtccaacttcattcttttgtatgtggatattcagttacagcaccatttgttgaaaagacttctctttctccattgaatagtattggcaccatttttgaaaacaaattggccaaagatgtatgagattttctctggactttgaattctgttccataaatatgtatatatatctgtgcttatgccagttaccatagttgtaatcattatgggattctgtaaggcctaatggatctttcttcctttctccccttcccctttcccttcccattcccctttcccttcccctttccctttcccttccccttctccttccccttccccttcccttttcccttttgcagagtcttgctctgtctcccaggctggagtgcagtgacataatctcagctcacttgcagcctctgcctcctgggttcaagtgattctcatgcctcaacctcccaggtagctgggactacaagcgtgcaccaccatgcctggctaatttttgtattttcagtagagacagggtttcaccatgttggtcaagctggtcttgaactcctgacctcaagtgatctgcttgtctcagcctcccaaagtgctggaattacaggcatgagcccccactcccagccagaagcttggttctaatgtatatactccagactagaataagaatacaatgaaatagtaaaaacttaaatatttatttggccatcatggtggctcaggcccaaggcccaggccggaagatctcttgaagccaggagtgaaacttaaaaaacatttttttttaatttgtagaaaatccccttggctagaggatttgttgttagagatagagactctgagcccaaaagtcttttctgaaggtaaaacatagtccttacaatgaaaaggggtgagaactccaaaattatatatggaagttgtatatctttaataacaaacattgaattactactaaaaatgatttaccaaaagtagaagaattagtgtctaataatgtattaataattaaagaaatagaaaacttaggcacggttttggtgggggttttttggtttcttttttgatagtcactatctctaaccagtaaatgacttaagagttttaggtttctacacattttaccaaaacagacactctagggtttcattacattctcagggagtgtccaaagagataaaattacatagttttcctaggaagattaaactgactttgaaacagtcttaaaacagcattagttagggcttctccaaaataaaaattgggctggtgcagtgctcacacctgtaatcccagcactttgggaggccaaggtgggaggattgctttagcctcggagttcgagaccagcaacatggcaaaacccctcctctacaaaaaattagccaggcgtggtagcacatgcttttggtcccagctacttgggaggctaaggtgggaggatcacctgagagcctgggaggttgaggctgcagtaaactgcactccagcctgggcaacagagcgagaccctgtctcaaaaaaaaaaaatggtaataatttttaaatgcatgagagtgtcataaagtttccataaactcattaaaaactcacctgatacagagcagttctgtatcttgtcattttggtgtgtcagttcagtctgaattgggatattattttgttccctttctctaaaaaggcacttggcatcagctttggcatttctaggcccagaagaatttcagagggatactcataaaaattggttaatgagttacattctcagaagaaacataacctatgggtactgtccagttgcaataaagtgtatgtcttatgtgctttttttattttatattttacttttaatgttattttaaaataaaacagagatgaggtctcgctacattgaccagtctggttttgaattcctgtgttcaagcaatcctcctgcctcggcctcccaaagtgctaggattgcagacatgaggcaccatgcccggccttcctatgcactttttgaaatgaaaataattggtaaacatgaagcatgtggcttcaaagtgccagttttcctgcttattagcatttaaactcaagtattcacatatgaaagatatttaccttacctgagtagataacaaaattcggttagcttcctggaagcttcagctcacagctcacaaaattactaaaatttatgaatgtgtttagttagagatttcactgataggttataaatcaaaaataaaattctaagcccccccccaccatcgtccctgccagggcattccaaaattaacctgaaaaactggttcaggccgtaacaggaagggaaggtcatgcctcgttataacctcttagaattcaggaaaagccaaccaacatttaatattaatacagcccttaagtctgataagaaacatttacagtctattctctctgaagcctacctaaagacttcatctgcacaataaaactttggtctccacaaccccatatcataacccagacaattcctttctactgataataaccaattgccaatcagaatttttttttttttttagacggggtcttgctctgtcgcccaggctggagtgcagtggcgcaatctcggctcactgcaacctccacctcccgggtttaaatgattcttctgcctcagcctcccaagtagctgggactacaggcgcgtgccaccatgcctggctaattttttgtatttttactagagatggggtttcaccttgttagccagggtgggctcgatctcctgacctcgtgatccactcacctcggcctctgaaagtgctgggattacaggcatgagccactgcgcctggcctgcctgtcagaaaacttttaaatctgcctataacctggaagcccccacctaccttcaagttgtcctgcctttccctactgaaccaatgtatatcttttttttttttttttttttgagatggagtctcgctctgtcacccaggctggagtgcagtggtgccatgtcagcttgcggcaagctccaccgcctgcgttcacgccattctcctgcctcagccttccaagtagctgggactacaggcgcctgctaccatgcctggctaattttttatattcttagtagagatggggtttcaccgggttagccaggatgccaggatggtctcgatctcctgacctcgtgatccgcctgcctcggcctcccaaagtgctgggattacaggcatgagccaccgcgcctggctaaaccaatgtatatcttaacatgtatttgattgatgtctcatatcacccttaaatgtataaaactatgctgtgcctcgaccaccttggccacatgttctctgagagctctctcaccatgggccatggtcactcatatttggctcagaataaatctcttcaaatattttacagagtttgactctttgtagacaaggtaaaaaattggtatctttgagtcttcaattctaccttgaatgcactaagccacgttaaaccataccactaagctttaaaaaaaaaaaatccttcaagcccttttctctcttctaaatatttcttttaatttaagagggaaatggtccctttcccagatattagttatagtgctttaaaatgaaaagaaacttattggccggatacagtggctcatgcctgtaatcccagcacgttgggaggacaaggcgaggggatcacctgaggtcaggagttcaagaccagcctgatcaacacggcgaaaccctatctctactaaaaatacagaaaattatctgggcgtggtggcacacgcctgtagtcccagctacttgggaggctgagacacgagaatcgcttgaacccggaggcggaggttgcagtgagccgagatagtgccacaccactccatccactccagtctgggtgacagagtgagactccgtctcaaaaaaaaaaaaagcctaccatcacgattctttttattggcttacattagtggtggaattttttccatctgaataattaaaaatgaaacttgactcagatggtaggagcaggtaaaaaataaagattaaaaataaaaacttgccgggcatggtggctcatgcctataatcccagcactttgggagcctgaggcgggcagatcacctgaggtcaggagttcgagaccagcctggccaacatggtaaaaccctgtctctactaaaaatacaaaaattagctgggtgtggtggcgcccacctgtaatcccagctactcgagagactgaggcatgagaatcgcttgaacccaggaggcggaggttgcagtgagtcaagatcgtgccactgcactccagcctgggggatgaaagcaagcttccgtctaaaaaaaaaaaattgctgctttttttgccctgttcagttcatgaatgaatttttagtaacttgtaagctatgggctgaaacttttaggcagctaacctaattctgtcatctactcaggtaagagaaacagaatttatatgtgaatacttgagtttaaaggccaataagtagtgattttgtttttctagtcttgtcctgttttttccatcccatccattttcttcctgcacactgcactactattaaatacctcttgccaaaatttggtttttgtcatgttcaagacttacttttaatgtatttgttcacttattcattctgcagatatttagtgcctactctgatctgggcagtgctcaactctgaattcttccaaccagctgtgcatgctgccatcctctctcttatgcagccttaagtttgtctgtccatggttcccatctttgctttatatccctggtcttaccacgctcttctgaagtacccatcctttccttcaaatacttttaggaaaaaggtctgataatagtgatttataatgtagttggatttaagtcgttgttttacgtctcaagaggcatttacattttgacttttcctataaatgtgaatgaaaagatacctctttcaaaaaatttagagcttccctgtgcaagtgttggaggtctcagggaggagagttctccctgctggttcttttgaatcacaccaaatgaatggcttgctactgttccctcacaccttcatattgtccatggtttttcccacctccttagctatacagctgctgttcctcctgcctaaaatgtctgaacattccctcagtgttcagctcagcccacatcttacatcttccctaaggatgtttttctgctgctatcattcattttcttcctatgagttcctctgttatattgcgtcaccatcactgaggttggcatttcttcattctttgtttcaattgactcatttcctttctcccaacttagtgtcttcttcaagaacactgatcctgtatttctgttttctatttaaacagtgcctagcaaagagacaggaatggcagtcaatgaatacccaaatagacatgagaatatgtctaggcccatgtatatttatgtatattttatctagcagcattttgctaaatgaatttatccttcattagaagaagaaaacatatcatacttaaggaccattattaaaaattcttaaaagtaaaaaaatagacctgtctgggcacagtggcacatgcccgtaatctcattactttgggaggctgaggtgggaggactgcttgaggccaggagtttaaggccagcccagataacatagtaagaccccatctctaaaatcaaaaaagaaattaaaaattagccaggcacggtggtatgcacctgtagtcccagcaactcaggaggctgaggtgtgggaggatagtgtgagcccagaagttcaaggctgtggtgagctaggatcactccatgcacaccagcgttatgacaaagcaagactccatctcaaaaaaaaaagaaaaagaacaactttttttttctataaatgctaatatctgaagaaaattttgatttttacttcttaacaggtggtttgttctggatgcagaaaccagagatctagtttctatccacacagacgggaatgaacagctctctgtgatgcgctactcaataggtaggcaaatttactcccacctcccaagcatggcattcacagcacttcactgcaattgcatagttttacttctaataaggctgactacttttttctctctttagagttgttaagtattaaatctgtttcccccaacatcaaattaaattctgctgccagaaactgcaaaagatctgctgaagtttaaacaacattctgaatcatcaaatttaaaatggacagctgcatttgcaattgaaagcagaataaagtgcagtcagatcccctttttccggaactacacatacttagaattttgaataggtattaggctaaatgtcacatctggttagcaagcttttctttatttataagagaatgtaaaagaaattacagcgaaattcaaaatacgcaaattgtataggcccttcaagtcctttagaatctagtgcattgtttcggttacatagtaatgattggtttgttaattaaatacttagcaattctctataagaatttgatatattcctttagcctgcttgagaataattatttgtactttattcacaatattaagtttctgtgataatactccagttaccttttcttgttattaatgtagctttgattcacaccactcttccctggagttagtctgacattgtctttatttgaaaatatatgccaatagttgttgcattagcacaggatccagagaatctttttgattgcttctcagttgtttcaaaggaagcacagagagtagtattctttaaattgaacaaggaaggaaaagtatgtactttaagctataagccttttgagtcctcatgaagcacaaaaattttaacatttttctggggtttgttttgttttattgttttttagtgttgtagtagcaaataaccactgcaaatatagctgtcgaattccagagatgacgtggactttattgaccatttgttacatgcttagcactgtggtgggtacagggaaggacaccacaaaagaaaggaatatggtgtcttcccaagagcacctgttctgtaattggacagatcatatatgctagatgaactaagcccctgtccactcagcctgccatgtaaacactgtacccttccacccaagaaggcaggataacctctggagccggttttcaactaactagaagatgaggcctagagtccaaggcctgtaagcatctccaagaagggattgtgtattagactggatgaccatttatttttcaaatgtacttagtggataggattcattcattaattgccaaatagttaaattgatgagatttaacagcatttgtaaaatcagtaaaataacagtaaataaatttatcagtatatttctctagtcaacactgacctattttattctagatggtaccttcctggctgtaggatctcatgacaactttatttacctctatgtagtctctgaaaatggaagaaaatatagcagatatggaaggtgcactgtaagtagtgaagtagaacaagttgtaaaattattgggaaattttacttccgttaaaaacaaatttttacatcgatgtgtgtgttgtttcctgtcgttagctgctttaatctctgtctttgaaaactggaactggtaatacatgatagcagaacatcagagttccctgtgtgctctaaaaagacatctccttttgatgggggtgtaatatttgtcactctgtgactagttttaaaacagtttcttaaagctatttccataggaaacctttagaataacactttttgaaaattgaatgagtcagaaataaaagaacatctcatgtttaatcttaactcctatgattctgcccacctcaacaccctacaacatcctatatcacttctctgccactgaaaataaaagaatgtatatggatatttgtctgcatttaagagagttaacagaaaggatgtttcctgtaatttattgcctacttctgccttaattgggttataattatagaatgaaaattggattaaatttctgtaagcatgacaagtactgaatgtacagcaggtattcccctagcaaacaaaatggcttaggcaccaggaatatgtacaacatgtgttcctttgtcctcaagaagtacagtccaactcaggccaggaagagaaaggtaggcagtgtagcacagtggttaagagcacagactctgagccagactacctgaatttgaattctttaacactctttaccacaaaacagttcattttagggaaacagataaaagaattagtttttagaagcatatacatcttgtaataagcaaaataaacttcaatatgggtctgaaatttattttgcttattatatttaagcaaaaactaggccatgtactatttgaggaagcagacttatttgcctttttgcatattttataccatatattaaaaccagagtccatttgtaaactagtctacaaacaacttcagagtttagaatttgtccaaaatatttttgtttgccttgacaataatgaatcattatccattaatttatttaaatctatcttttaatttatcaacttaatgtttgtcttatggaatagtacacaacatgattaaatgagatattccaccaaaagaagttttcagatcactgaagtttaccctaccagacccccaattttttttgttttgttttgttttctgtttttttaatcttgttttcacttttgagacagggtcttactctgtcacccaggctggagtgcagtgcctcaaactcctgggctgaagcaattctcctgcctcagcctcctgactagctggcaccataggtgtgtgccaccttgcccggctcacttttttaatttttcatagagctgaggtctccctatgttgtccaggctggtctcaaactcctggcctcaagcagtcctcccacctcagcctcccgaagtgatgagattaggcatgagccactgcacctgtccggtttttaatctcaaccttttttaaaaaaaaagtccataccttaataaacagtatatcaaatatgacttaatcttgtagaatcaagattttacaggtagccctgtagcacttagcccacttttcagagaagattaatgacttgtcattggtgtcatcttgtgacgtaatggcagatcaaggacttgaacacaattctactaactcttagtagagccgactttccaatgtacagtaatgcctcaggtttttcatttcgtgtcttattttactgtacaactgatccagaagagagagcaatgtgtgacatggaataatcagaatgacttggaagtattgagaaatggcaagtttgtcaaatgcatgagacttgtcctaatccagttaggcagttctttgaagcgtttgaagaaagtattaatttgagatacccataggaactgttaaaagtttgcagtaccgtttgaggttgtaatgaaaggttcaactattctgcgttcctaattgtcttcggttttgtgctttgcttctagctttcagttcttgctgcctatttccaccggctggtcttatagtcagtcccctgcttttatctattgtctgctgttatataggacaggcaaaactgggtcaacactgtctctgctgcttactagtttgtgactttaggcaagttaacttctcagagttttaattttattatcttaaaactggagtttataatagttcgtactttatagcattgttgtaaagatgaggtctttttaaaacataacaactagaactactctcaaagttccaaatacaaatgctattttctgtttctagtaattttcctgttaactactcaacatttaggtgactgttatagctgcagaagcacagtacgcttagagctttaggaagtgtcactaataaactatgatatctctaattaaatgtctgtaaattataaatgtctctaataaaaataataaagtaaatcttataacttacaatctaacaaattataagttatatgcatttggagtctctcttcacagtagctctctttatgtggaaatgtcagttgaaaagatggctggtacccaatgatgtgaaacagcacttcttggtagagggcagctagctgatgcatgggtcccttaatgaatgatgacatcattatagtccagggccttgctctcaacttcataagctaagaaacaagcttattattactcacacctgtaatcccagcactttgggaggccaagatgggagggtcactggagtccaggagtttgacaccagcctgggcaattaaccaagaccctgtctgtattttaaaaaaaaaaaaaaagctgtgcttaatttgctccagagtcatctgacctagttttgaaccctgggtacaccaattttttgttaagtaacttcagaaaagttacttaacctatctatgcatcctaaccatctcacctactaagtggacatcctcattaaggttgccatgagatttagatgtgatgatgtatgcaaggtacttagtaaatattaggtattattattagcattattttccatgactagatgagcctgggttgtacctacgggtatttttcagcatttaacagtaatctattaaaattcaaaaatagttttacaatgatgagcattgtgtattttccttgaaagattttaagtgtcctgattgacctaaagtttctactcagttttcagtggaatattaaggttgttttattatgtacctgagtgtcaacataatggctttctgcttgactcaaattcctgtgtaccttttaacactgttactcgaagatcttagcccaggagacagtatatttaagttgcagtgatatcctaaaaagcattacaaaatctcttggagtaggcaagaagtgctggtaaaagtaagtttgcttttttgccaggatttggttaattggaaatacacatcaaaaagagggggaaaaaaagagtaaacactttatctacctagaaatcgccaagaaaataaatcctgaagttaatgcaggatttcagtaaggtaatagaattcagtatcactgtgacggttaagaattatgtgtagtaccaggccgggtgctgtggctcacacttgtaatcccagcacattgggaggccaaggcgggcggatcacaaggtcaagagatctacaccatcctggctaacacggtgaaaccccatctctactaaaaatacaaaaaattagccgggcgtggtggcgggtgcctgtagtcccagctacttgggaggctgaggcaggagaatggcatgaacccgggaggcggagcttgcagtgagccaagatggcgccactgcactccagcctgggcgacagcgagactcacatctgaaaaaataaaaaaaaagtagtacctattcacttgaacacatcagggatatggtctcatttaaaagaggccatcaagaactcggatcctttctttctaagccatcttattagtatgttgcttccatcctcaacatcataacatgctgctggaactccagccatcatcacctagttccaagcagaagggattagagcaagtgacaaaagagcactccttccactaagtcagttctcagagttttcctggaagccccacacaatgacttctgccacccctaacttcaaaggagctgggaaataatagtgttctagctggtcactcaacagaagggggataatgtggattggagaggcaactagcaggctacactctagtcactaggtaaagaccacttttcctcaaaccagcaaacgcatatcaaaaatgtgggagaaaaaatgcattcacaatagcaacaaaaactagatgctttgagaataaacatagcaacaaaagcacaggaagctgtgtgaaacattgctgaaagacataactaagatctgaaagaattagacatagcatgtttctagataacctgataaagatatgttttctacaaacttctctaagtttgatatgatcttcagattttcaacatatttatgggattaataaaatagttctagttcatctgaaattttccacgtatcacagaactatcatggttgggaataagcagatagactgatggaacagaaaagcatccaggaacagatttatgtttttatgaagtttactaagtaataaaaacggtatttcaaatcagtagagaaagaatagacttctctacctgtattttccaatatggcaattactagccacaactttctgttcatatcattaaaggcaattcagttccctgagagtgcagcaacgtttcagttacttagaaaccacaggggactagttgctactgcattggactgcactgatacagatattttttatcactgcagaaagttccactgaacagcatagctctaaatggacaaaagttaggtcctaaattgagaccttggttgcttggttgcttggttgttttttaactccccaggtaattttaaaccagttgcaaaccactgattcaggtgataatcatcatgcagttgacaaagatttaactcaaatatttctgaattttttcttcatagccatattctttcactttgtcacttgggattatttttgtggtaacgccatatggctatttaatgacaataatgaaagggccagcttagaatacttttttgtttgtcttcaaggagatatactagaatttgctcctgtgtttgtgcccatggagtaaagtttgaggcttttttctaagctgtgcatacactttgcattagcctgtgacttgggtagaggaaggacactgaggtgatttgtggggagggtaacatagaccccaacagctgcatttcatcttttctttgcttatttattggaattgatgccaggcagaaaatactttcatttctaaatatgagttaataactttcctaagatcttttctaaatttggggacttctcctactcaagagtcctttttgagaatactttatgttgatttaccttctgaaaataatctgtgtccaacatagatgtttttgcatgaatattatgtatatatacaatgcttttgatgctcttctaattgaactattgaaagctttgcacaaagctttgcacaaagatgcagatagtatttttaaatactattccattagggtgaaattctcagaggcctgtactttgccatgaccaatcttgttaaatcttcatccacgtagcaagttttaatttcagaagcatggcttccccagacgccagagccaggctcatgtgcactatgaaaaggatgtatgaaccctgccatactcagaaaatagccaacatccatgtgcatcttgctgtctctgaaaattgatttcttaagttagtaggtcccctgtatgcctagcaagtgattcccaacgtgttttccaatataccgcttaattctagtgatttcagaaagcttcacttctcagattcatataatttaaattggtttaaatatgtttatttcccatacagcactatggtggagattatggctccagaaaggtttggggacacatcggtagacttcagaagggtactaaaagaattagagtcattgttctaatgtaaatcattaaaaactatccctaaggtacactgaatttgttaacttacaaaataaaatcctggtcaggtgcagtggctcactataatcccagcactttgggaggctggggcaagtggataacttcaggtcaggaattcgagaccagcctggctaatgtggtgaaaccccgtctctaccaaaaaaaaaaaaacaaacaaaaattagcggggcgtggtgatgcgcacctgtagtcccagctacttgggaggctgaggtgggaggatcacttgaacccaggaggcggaggttgcagtgagccaagattatgccactgcactccagcctgggtgaacgagtgagactctgtctcaattaaaaaaaaaagaaaagaaaaagaaaaagtcttagaggaagaaaagaataggtgaaaaaaaataaaggccaggtgcagtggctcacacctgtaatcccagcactttgggaggctgaggtgggcatatcacttgaggccaggagttcgagaccagcctggccaacacagggaaaccccgtctgtactaaaaatagaaaaaattagctgggatggtggtgcacacctgtattcccagctactcaggaggctgaggcatgagaatcatttgaacctgagaggtggagattgcagtgagctgagattgtgccactgcactccagactgggcaacagagactctgtctcaaaataaaaagaataaaatcatgtgaccagaaagctagtaattgaccggatacagtggctcatgccagtagtcccagcactttgggaggctgaggctggaggatcgcttgagcctgggagttcaagaccagcctcggcgatgtggtgaaaccttgtctctgcagaaaatacaaaaattagctgggagtgatggcatgtgcctgtagtcccagctatccaggaggctgagaagtggaaggatcacctgagcccagtggggtcaaggctgcagtgagccatgatagcaccattgtactccagccttggcaacagagtgagaccctgtctcaaaaaaaaagttagtaattgaaaaagcacagtagaaattaaatgtgtttgaccacagactgtaggaggtaaaagcaaattcaagtctctgtcagctttggtgaaccataagatctgtgtaatttatctgaaatagtttattggaaatgcttaagtgcttatacgtgaagccaacaaaaattagtgtttcgtagtttttttgttttaattcccacagtgtgaaaacctaagcagaaaaagatcgttgtttcctgcttaaggaatgttttaaggaatcatgattttattgagacctactgttctgatggagtacagcgttgggtgaattttccccaaaacattctttagagatagtctttctaggatacctccatagaccatatacgggtgctgtattcctcagcttctgagttgtaccatggataattcagaagtagcccaggaaaactgtattcctgatgccttatgcacaacttataaccaacacttcattctcaaaaatggagtcactctcatggggacaccagtgacgtgaaataaggccagagggtgtggtatgtgttgcaatgtcctgtaagatacaagtttaagagactgtctttcttggaagtgtctaatacaggtagtaggtgctagtttctggtatctagataggccagaaagtttctcccaggtttcaagtgctgaggatttgctgtgagcctgctcagttttagagggtgtgacactgcttcctctcctttagaaattccaacaaatgtgtattcagaaacagtattggctagctgttgaactgtttatcattcagaactctaaatgctttctaacaatttatctgttattttctagggacattccagctacatcacacaccttgactggtccccagacaacaagtatataatgtctaactcgggagactatgaaatattgtactgtaagtatgaatgattttatatatatatatatatgctatgattatatttatatatatatatatatatatatatatatatatatatgctaagatgtgtctgtcaggggcgctaatgaacaggctgcatggaatctgaattgtgcagagaatgcttgccaacctctttaacctgacaaagcatatgttatgctgagctaaggtaatgagaatctcaaatgtgattcacttctccaagagtaatgaattaatgttaatagtgtagaacagaaggcacatatagtaataagaaattactctgtcaaattgatgctgctctgaatggtttttcatttaattacttctcctggaggcagggaggaatatgatagatgggcatttatgctttttagaggaaaaaaaaaacttccatgggaaacagtttgtagttttataaaccctgttaaagtgaacactttcttttcctttttaaatgtgtcttaatgtttttcagtgtatggattataaatacaagtaaacgtggctagtttgaatcaagatgcactttcaaatacatttgtacacaagcactatgattatacttcctgtttctaaatttaaaggggacattccaaatggctgcaaactaatcaggaatcgatcggattgtaaggacattgattggacgacatatacctgtgtgctaggatttcaagtatttggtaaggaaatgacacctgatgtaaagaagtggtttgtgggttttttatatataatatttacttgcttaaatttataaatgaaaaatagtctgtgtattctttagctttatcactattaatgtcagcctcagagaaattaaatgtattaggattgaaccaacatgggatttgtattttgcagaatcaagcacttttggtccttaatatgaaagacaaggaatttacatagtagtacagattaccttcccgtttttctttaagtgaaaattgaagttattaaatttggaaaggcatttttaaatagcttgagatacatgccatacaattcacctaaagtgtaaaattcaggctgggcgcagtggctcacacctgtaattctagcactttgggaggccgaggtgggcaaatcacctgagttcaggagttcgagaccagcctggccaacatggtgaaaccctgtctctgctaaaaatacaaaaattagctgggcgtggtgacgtgcacctgtaatcccagttacgtgggaggctgaggcaggagaactgcttgaacctgggaggcagaggctgcagtgagctgagattgtgccactgcactccagcctgggtgacagagtgagactccagctcataaataaataaagtgtaaaattcagtggtttttgtatacttagttgtgtgaccatcaaggtctaattttagaacattttcattaccccacaaagaaactctgtacccattaacagttaccccatctctcttatcctctaccccaccccccagcaaccactaatctgttattgatttgccttttctgtatagtttatataaggggaatcatacaatatttgatccactgagactagcttctgtgatttagcataacgttttcaaggtttatccacgttgtagcatacatcagtactttactctttttatggctgagtaatatcccattgtatggatagatgacattttgttaattcattcatcagctgatggacacttgggctgtttctacttttcagctattatgaataccactgctgtgaacagtcatgtgcaggtttttgtgtagacatgttttcatttctcttgggtatttacctaggagtagaattgctgagtcaaatggtaactgtatgtttactcttttgagcaactgccagactgttttccacagtgactacatttacatttccaccagcagtgtacgagggttctggttcctccatgtccttgtcagtgtattttattattattttgcgtgtggatgtctagttgccttacaccacttgttgaaatacaaaggcatttttaggagaattatataaagataactatgtggggcttcttcctaatctgacgttttgtaactttctggaaatccgacctctatgactgttttctaagccttcctcagtatttaggtatccttctgaaagggttagaagatagatggaaaagttaaaataataaagcgttatttgcaaagaattaaaaagaagtgttatgctcaggtaattaaaatactggatatggatgtggcaccaatacctaaagcaatacacaaaaattaatattttctctttaacaatttatctctgccttctgaaaattgggttctccagcctgatcatagatctgaacatttctttatgctatgtgcattaggaaaataatccattataggtggttgttctaaacacaagtgctatcaagacagagaagcctaataggccaggaaggaattaaaaacaaaataattctgtccataaacaatttcattattctacgtgaaaatgaagcagtgacccatagctggtagcttctgtggttattttaatgaagacattatttatttaaattattaagagagaccaattttaaagtattttgacttgtttttagcaaatttaccaaaaacatatttgttctctagagtagcattcaaccacaagtggccaacatctcaacccttaaatcttccatagtttcaatctagcctaatagaggtttgtgaaaattatgttcgacatgatcattagtgctgcataatgattcagaataattaaatttgacgtgtcttatcttgggacataatctttccaggaaaattacatgggatagcatgctaaactagtggatggcctatgctttctaaaagaaataatctctctgaggttttcttggaggtgcttgcctgaaagaaaacctagactccacttcgaagacttggtgttatggctttgtttttgaaccttgtctatacaagtaactgattccctccatccagaaactttaaaaaggaagagcttattgctgaggtgtaagtcaagctgaaagtaaaataaattattagcaccacctgctggttaccattgagtaccattgagtctttaagttttccattttggggctattttggttttttattagttagattttggacaggacttgatttgaatgaagaacagtgtgagccactgagaaatttgtaaaggaaatgttaacagctaagagtttgaacatagataaaagctaaacagattctaaaataaaataaacatatatagcatcacagttatatttcttcagctaatttttctgcatccctgtgtttccatatcaaaggtgtctggccagaaggatctgatgggacagatatcaatgcactggtgcgatcccacaatagaaaggtgatagctgttgccgatgacttttgtaaagtccatctgtttcagtatccctgctccaaagcaaaggtaaactcactttaatagaaactaatgttataaggccttctgtccagggatgattttgcatccatagcaagaaaatataggttactgattcctctccatgatactccagtgcacagagggagataagggccatcggtgagcatccatccaggcagtgcttgtcttctcccccttcctaaggctaaggagaagtgagctgtagaaatgacgaccgatgatgttattcctgtttctttattgtccggttgctttttattttgatttgttggcaatttaaaatctctcctaaatattttaaaatattttatttgttggatacatattcaacgttataaaactaatggaactgtttcccgaatgtcctgtaatcctaccaacatagtaaatgttcccctaaccatttcagaagaataattactaagctctggcaagtatacgaccaacatctagaagagacagacttttagctatttttttaaacatatagtgtgaaaatacagagatgtccaattcttctgtttcgtttttcctatgtaaagtgataataaaaggaaataacggctagccttactcctgagatttgatgacttctggctttaaattggattgcccatttcacaagctgagtttaccccccttacgtatcacctccatttctgaaacaggcatgtcaagaatgagtttaattttcctgtctgtctgatttatttcatataggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttatattcacacgctgtatggaagggtgtgggtgtgtgtgaaggggcgagtggagacactgtgtgtatctctagataagaagatatgcaccacgttgaaaatactcagtgtagatctctatgtgtataggtatctgtatatctttccttttgtttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagttcttggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttctaa

SEQ ID NO: 5 - DNA, 137489 bp, Homo sapiens
  misc_feature: ROS1
caagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctggtaagtctcacaatctaatatttgtctttgcaggaactagaacatgtagcattcagcttgttataactgatagaattgttttctctttatgaggagttttcttatgagaagtggtggcaacaaggcaagatagattattttttcttaaataagttaggagcccttataattgcagaagataaagcaggctattttatttctttagggtatgtggtcatatattttttgggctagaggactgggtaaaggaggtttaaatggaatcaattttgccaattttgcacacttaaaaactttctatttaaacttatttattacaaagtcattagtagttgtcttgaaacctgaaatcggtttggccacaggataatgcctgctaattccagctgtgtagggagctggatgaaaaaggaagcagatacagttgccatgtaaaataatattttaaagcaataattatttgtacatttctttatttctgtttgtgcatttattattttagttagtgagttttttatatggaaattcatgctttcattctcatttctgggtgtcatcccttctctaactattgtaccatctcttttcagttgtaatttagttgtgcttaaaacagtcactgaattaactttaaaaaccaagtactctatagacagagaaaatgcactcttcctgtctaaagacaaataaaatatcatgatagtttgcatatgaccctatctatagccatacttttaaacataatgcaagtactaaatatagtattcattatattattctaaagtattggagatagaattatgtggcagattaaaaagaaacttgcacttatacacttttgatttaaactgtagtttaaaacactacttaggtttaccatggttagtagcatttttttaaaagtttagtattttatataaatctttgccgaagacttcattgcctttaatatagaattgcatgctttagttttttatatttgtaacccaaacttaaaaatggaagaatggaactactaaatgtttcaactactgaatggaaaactaaatgttctaaaaaagattttaacttttttctaattataataagagtatacattttaaataaaatatttataacatagagaactacagaagaataaaaaacttctaattctagccctagtaatcttttgattgaattttcttttagtatttttcctcatatatatatatgtatacatatatatctataatttacacccagctatgcaaccagctttttcattacattgtattgtgagttttcccctagaccctgagatttttttagaaacagaatctttattatctttagagtattccattatatgaatgtaccaccataatttatttgttaatttccctgctactgaaactgattttagttgtttccaatattgcagtctccattttattttactgtcgttttatttattcttatctttttgtgtgggctccttgcttccagggtttggcagtaggaatagacagtttgttcctttgttgagttgccttccgttcaccacctacagagaatggcacagctgatgtgtggcaacagcaagagagacacggtctgccaatttgaccagtgaaagtactacatgttcccacatagggcctggagggacaaaagtgaagtgaatgtacaattgaatgtaaccatggttcacaggagaggatatacaaagtgctcaagtttattatattttctgcatcatttttaaaaacatggacatttactctgaaggtcatctataattttattgggtgattcttgatattgagaaatgttttcttaaaaaaaaaaagtcaccacaagaatgtcttgtccaaaaataaaatgttagaattgtgggccaaattgcacgaagcagagttctatgcttgagcattggtattttacattacttttatcttacgttaacagagatctgcatgtactagttgaaagtattaactgaaaagtttttttgaattctagaagccatgtgctgcagaaaacaacaaacaattaatgctcttcagaactctagtattgtgagatcctttatgataaagaaaaaagaattcacggttgaatcatttgtggaagtgtattttgctatgccctctttttgtagattcacagggcacaataacatgttaaaagctttgtttaatcataattttcccatctttagcaacaaaacccttttttaatgtttccataagttattgggggaacaggtgctatttggttacatgagtaaattctttagtggtgatctgtgagattttggtgcacccatcagccatgtatacactacaccatatttgtagtcttttatccctcaccctgctcccactctttcccctaagtccccaaagcccattgtatcatttttatgcctttgcattctcatagttttgctcccacttatcagtgagaacatacgatgtttggttttccattcctgaattacatcacaaacccccttttttttttgaattaacaaatcacaacaactgaggaactaatattgagaagggctcaggagtatcaattccattcaataaatttcattcaatatcaatttattgaatggattccattcaataaattttcctaggtatctatgtatattcagctctgtggtggatgcaattcggaatacaaaagaagtgaattatgtaatcaatgccctaaagtaagttatcaaatactgagatatcaaggtttctatcactagacagttaaaggctgttacaaacatgatgtgcttttataatattagagggtgatgacaatacatttatttttgatttgtatcttaagttccaaagaaataaactgaaaatcaactgaaagactattagaaataataggatttggaagatttttaaaaaattaatgtacagacatgaaaaattgtcttgtatatcaatatataacattaaaacaaaataatataataagatcataattcagaaattttataaaatatttacaaattagcatagtttttattgctacaggaataaacctgtgagtaaaacagaatacaatcaagaaataaaaccatgtacataaagaatgtgaaatatgataaagatgacaattcaaaccaatgagttgctatccatgtagcataaaaaattcctacataactgccagattcaaataaatttcaggatatattttgtaaaaaggtatgacttttggttaagtgcgatggctcatgcctgtaattccagcactatgggaggctgaggcggacagttcccttcagcccaggagtttgagaccagcctgggcaacatggtgagactcctgtctctacaacaaatacaaaaattagctaggcgtggtggcatgcacctgtagtcccagctacttaggaggctgaggtgggaggattgattgagcagggaggtcgaggatgctgtcagctgtgattacaccactgtgctccagcctgggtgactctgtttctaagaaacaaaaacagaaaggtttacttaaatgcaaacagacaaataaacaaaacaaagcaagtgtttacttcataaaaatattagaagaaattggggtgactgtttctgtaatcttgaagtagaaatgccttaagaagcctaattaaaaaatttagactccctaaaaagaaattatcaataaatttgactacttagaaacttaaactgttatgacaacagtatacaataactgcaaagccaaaaagtggaaaaaaagtattacacatgataaataatgtttttaaagaaaaaatccctgatacacataaaagcatgtaagatgaatttagaatataaacagccacttcaaaaaagaagtataagtgtccatcaactgatgagtggataaaaaaatgtgatatatatacaccatggaatactactcagccataaaaaggaatgaaataatgtctttgcagcaacttggatggagctggaggccattattctatggaggccattatttggccaggaatagaaaaccaaataccgtatgttctcacttataagtggtagctaagctatgggtacacaaaagcatgcagagtggtataatggactttggagactcagaagggggagggaaggagaggagtgagggatgaaaaactacatgttgggtacaatgtatactacttgggtgaaaggtgcactaagatctcagacttcaccactatataatttatccatgtaaccaaaaaccacttgtaccccaaaaggtattggaaatatatatatatttcctatatatatatatattgcaatataatatatataattccaatataatatgtattccaattcatatattccaatataatatataatatatattataaaaatggctaaaaagcatgtgatagatattcaacctcacagcaaccacagaattgcagaataaaaataaattatcaatttttcttctatcaaattggcaaagataaaaacatttatagttgggaaaaggtacaggtaaacttctattttcatgaattgttggttggatgtaaatggataaatttctagaaaagaatgcgttattaaatctcaaaattgaaagagaaaatatacctctaatttatgcatcaaatttatctgaggatattattgtttaactaaccaaagatatgtatgcaaaaggctgttaacagcaagttgggacataatactactaatacatttctaagtgcctgcactgcactataataattattgcatttaattgaatcttcacagaagcttatgaattaagtattatcctacttatgtcccggatacgaccactaagtttagatggcacaggtaactttgagaatatcacattgggagcaaatatcatgtggaattaaaatacagatcattctgctctgttccatttattattattattattattattatttaaaattttattattattatactttaagttttagggtacatgtgcacaatgttcagttttgttacatatgtatacttgtgccatgttggtgtgctgcacccattaactcgtcatttagcattaggtatatctcctaatgctatccctcccccctccccccaccccacaacatttattagggtaggaagtaaagaatgagattagttctgcctgaggtgggcagaatagaaaagcttatgtcaagaagtgggtattaggttaagaaagtttgagatctgggactgaatttgactactggaagcagataattggcgtagttggagctaaggcaaaccagcggggatcctaatgttcaaaatgaaaaatgtgattttggtggagattatggaaggcatccggttaagagcacaggttctggagtcaatcactctgcccccttcaaatcctaatccaggtaatttactaaacttccctgtgccccagctgtaaaatgaggttaattatagcagctaccttatagggttgctgagatgattcaatgagatttagtgtaaaacacctataagagtgcctgaaacatagcaataattcaataaatgttagctattgtaattgtgaggagaagaatggggaatgagtggagattagggaagagtgttgacaaaatctgcctcattagaaacccttagacctgactgtgaggctaccctgcccaagaccatttgatggtcatttcactcagcccgttaaatttactcctgagaagagccatcaggactcactaccgttacagtgtgactatgatcatcaagaaatatctctgctctcctactgtttaaaatggaacacaaagactacccagcatccacccttttgcttttatgagttaacatgcatttttgaaggggtaggaaaagattcaattttcaactcattatctctcacctgatttttatttgcttgcgattcaaccaacttttgaacaaaatcatgaaaacacagtactattaagcactcggttgcaaaattcatctaacagatagaattcttactgtctaaatgtttattatctaaaaacaaaagccaataatcatccttcttcttttcctacaaatataaccggttagggaacggagtttaaaggaatcctcactcatgcttcaaattaaagaaaaaaacaggcaacatttgttctttggttcttgagtctgattacttttcaagtcaacccacacaatattaagccattggataatgttttcaagggacttttggagcatccttacatgggaaaccactttgaattaatggatttactcctttagcacatcagtatttattgaacacctgtttctagcaggcagtgttccaggtgctgaggatggagtgaagagccaaatggatagaaagcaggagcatgctcagtgagctcagtgatagaatgctgctctcttctctctagcaagcacagaacactatgtgggtacttatctgattatctgatggcccagattatctgattgccatcctttgtaaactgtcttgtttatgaaggactctattcaaattatgaccagagagataacgagcaatttatagatctctgtccttagttcctatttcttttattttcctccagtataaaaaagttcttaaaatttgtatgtgagccataaaagagtaatcttatgttttactacataccaatttgcattttctccctgctcttaattttaaaaaggaaaagtctgaacacagttcatcactcacctaggagtcctttgacttgattaactgaccaatgccacaggattatttaattctgcatgagactctctccctatagccacattcttacttccacctttgtagtacctgcaaagttcttaagacattatatctataatttgcaccagcattttgtctggtagtgatgaatttaatgcctctaaaacatttggctctttactttagagttacaaaatgcggaggaggcaacgttatttcaggaagcttttttaaaaggtgtgttagttacacggaacccagtactgatggctggtgtttactacctccttcttcatttcagggccagcagcttgaccttggcacaccacataatctgagtgaaccggtaagtaatttcttcagttgtcaagaatattacaatgtttgtgttgataatgaagggacaatgatcagattttatcacagtaagaattgctaagtaaaatctcatttatccttgctggaagaagacaaattgaaaataatgagaagtctgaatttatataaaaatgaagtgtgttgaagtggaaatagcacaggaccaatccaagtgcatgattttgtctctatgtaattgtgtggctttggacaaattacttaatttttctgagatttagttttattatgtgttatttgagatcgtctccaatatttcttctaacaatgacattttatggttttattactgttctgcacatgtattcatttgtttaacaagtgtttagtgacttaaggtataagcatgcacaaggcactgtgccaggaactagaaacttaacaatgaaaaaaatagggtctctgtttaaaaggactctcaacctttttgagatgcatacttaaaaccagagagacagacatatgcataaaattatggccagacagcatcatcagaaccagaattgtggtgtgtgtgaggagtgaaaagagaatacacaagagtaaaaggcacctcacttgcctgcaaggccttcaaactaaaactagaaagaggaagagttttccagatggactagaggggaaaaagcctatcgatcagagaaggccctttttgtcaagacacaaaggtgtgaagtagcctaagttgttaaggaaactgagtatttcagcttgcttggaaattggggtacatgtatagagggtagggaagtggaagacccattgccaagttacataccaattgccaagttacatggagccacattacgaagggccttgtctgccatgcttgctaagttggtcttaactcacaagttgttggaaagacatacagagttttagataagagtgtaaccaggttttgttttaaaaagatcactccaaatgtgggaacaagaggggtccttcctgaggtttttggcaagtggtaaatggcaaaacagaaaattgaggcagtgagtgatgaactcagatggattttagttaatgaccagataagtcaatagggcttcgtgatgggttttccatgagaggggagagtggggtgagagaagaaaacaccctggttccaggcttggacaactcaggagaatgtaacgcgttaatgggaaacacaggagaaagagcaaatttgaggatggaaagtaaggaattgaattccacatgatggatctgaagtgcttgtaggaacttaaatggagacatctaatgagccagtggatatctgggtctggagctcaggatggagcctcagctgcagttagaagtttgggggatatcaacatccagattacttgaagctgaggtaggggatgaactcgctccgggagaactagaagagtgagaggagaaaaagctgaagatggaacacaaacaccaaaggggtggagagaggcaaaaagagatggcaaaggagactgagcaggaagtaagaaaaaggaatccaggtgccaccgtggcctgtggagggaatggtcaagacaggtacagatgaattaagtaaggtaagaagaaatatatcaaatctgtctgatagcaggtcagggcaactcagggttttcagggcagctgtggggtgaaaggtgctagtaggcagccgactccccaaactgtctacctatttaggtttgacatgctaccatctagttgaatcaccagttttgagttttgcttgatatgtgaggacaccttagggacccaggatataccaatgccacattgtcctgggctttacctttgacaactacccagtgtacggtgtcttcgctgaaggttggctgttctctggcttctaggcctgcacatgccaggcttaactccactcagcaactctgctgccctgcagtgagccacaagacttgttctacctgtagataggacagctctgtttggaatcccaaaatcctggatcttttggaggcctcaggtttcttggtaggtttctatttctaaaacacagagtgatgccttttgttactacattgtactttcaggtgacaagaaaaagtcacatttcttcaatcactcaccattgtctgttattgtctcttgcagtgtatccaaggatgtcacttttggaactctgtagatcagaaaaactgtgctttaaagtgtgtaagtattaattagatttctattttgatactgatgtttctttcaagaggaaatttgtgtaagaggattcccatttgcatttccattggctttcaactagtttgcttgaccctaagacaaaacaaaacaaaactaaaaaaccaatagcctggataatacatagtaatggaaaagagattgagattaacatttttaatgtgactagaggtcacggaaggttattgccaataacagaacccagggatgttcaatcgctccaaaactataaatgttttttagtagaatctccggtatttgttaaatttcctaggcctatgcgtctcaaattttagtgtgcaattatccgggatcttattaaaatgctgattctgattcaataggtcttgggtggagcctgagattctgcacttgtaacaagctcccaggtgttgcaatgctggtggttcccagaccacattttggataccagggccgtaggtcatgttcaaagtttctatgcaggaaatatagtaggtgtctaactcagggccgtaaacacctggtttactcccctttatgtaggaaatacatccccagatactttatttttcattttattatgtagcctggcttttgccactcagtgtgtaacttaaggtacttaaccccttggtactttacattcttcatccattttaggataataacagaatctttctcctaaagatagagcctgtcgtgttgtaactactctgatcacatgattaagaattttgccttttaaaagtgggttcccttgtttaggttgttcaggtcaggggttaaatcaataagaattgtggtaatgctggggaatcctaatgtcattttctattaatgagttaaattataacattgagatttaaataatgcattaacctctttttatatacatagtttttagagtatattcatagttttacttatatagtgtgtccttgcaaagttctattatagcagttacctatgcccactctcacatttgtgactgagtgcctcacagaatggaagttaccaaaaggtacagcatgtgctatctggacttagtggctattaaatatttctcagaaattgcaactcaaacaaataatttgtctagttgtgtgtttagtatcttttatcccaacatgtaagctgtgttggggcaggatgctgtctgtcttttttagattgttatctcttgcactgaatacagtgcagggcatatagcagctgctcagtcaacatttgctgaaggaatgaatgggaagcaccatttgttgctgggaaacaatccaggaggctgtgtggctgctgcagtggccagcatgggcagaggaatctgctgtcctttgctagcaagagctattggtggttttcatttcctgttctatttacctttggcatttgcaaatactccttcactctcttaacttggtccaccacagattacctcagcctgctgagatttttctggtggacatcatattctcccatttttccagtgatgcaaacagcttaatttttagagctgcttatacagtgtcctgcctagacagggggtcctgctctgggctcccttgtttctgttgtttttttggttgtttatcaatggtggggcaataaattaatttgaaatgattgtacagctcagtgtcactaaaattatttacaactttcaagattttaagtagtctttttttttttctatgcagaatgatacttatgccaccgtttgtgaggtgagttggcaatcacaaaaaagatgtaatcaagccacatgtcttcatctctggtctctaaaaagcttttaaaataggggtgaagaaacctaaaattctcagtgcactgagacattcttcctcaaagtgttattactctgagtatacagatgactgtaaaattccattttggcacaaatatttactgttttatgtatctatgtgcatgtatataatatatatgttcctatgtgcatacacacacattcaccatttgcatatatattactctaatctggtttgggaggttataatccctggaccctgggcagagttggagttggggtaatggaggggagagaaggaagaggcacattcagagatatctctgctgattccattttcttccccacaatgtatagtgctctatcattaaatataggacattaaaagagaatcctttaattgcaactttctttcttgcttgcttgcttgcttactttcttgctttcttcctctctttctccctctctttctctctctttcttttctttctttcttctcacagtctcactctgtcacccagggtggagtgcagtggtgcaatctcggctgactgcaacctctgcctcccaggtttaagtgattctcctgcctcaactttctgagtagctggggctacaggcatgtgccaccatgcctggctaactttgtatttttagtagagatggggttttgccatgttggccaggctgatctcgaactcctgatttcaagtgatccacccacctcagcctcccgaagtgctgggattacaggcatgagccaccaagcctggccgtaattttctttcttgtgcaacaaaatcctttgccaacattttgcaagacagcttctacccaccccttctcccaatggtaagtaatgtctcacactgccctgcccaggtgtccttacggtgctctaagcaacctctgctacacttgattttctctctttcaaagagaccttgacgttttgatgtttcctacttagtcttcagctgaacttacctgtcctgtatttcatcccttcaaaataaggttatttgacaatagatgatatgaagaagctacattatttatcagtttaaaacctatgttggctgggtatggtggtgtgcacctgtaatcccagctacttcggaggttcaagtaggaggattgctggaggtcaggagtttgagagcatcctgggaaacatagcacgactgtcccctaaagaaaaaaaactttaaaacctatgttgtattcttttttaaatatccttgaaactggtaaccagaagcctggggaagcagtataaattatccttcattagtaaaacagaaaaaattccctcttaatagagagcaaaaatacaaacaaaaaattaaattggcatgttttctcagttgttactggttggttataaaaattgcatctgagcaatttttcttgggaatgggtggaggtgagggttggctaagaagagagacagaaaacagaggagaaaagtcacccatatgtaaagagacaaaggtctctcctcattgagatagaaaaaaaaattgcctgcaaatccttttatgtgatgaaagcaaaattacccccaaagaatagtccctaggataaatgtaccagtgtcaggaaaatcagggagagagagcctttaaagcatcgaagcagcccaggattagatctgtaatgtgctaattctttgttaatcattatgctgctcagttttctgtgattatatagtgtaaatctttcctctcagtgttataacttgtataactattctttctctttatactttgctattttacactttaaaatgtttcactttaaataaagtagaactgaacaggaatacatgctatgtgtatatctatctatctatctatctatctatctgtctatctatctatgtacctatctatctatctatcacctcagttatccacacctttaggaaatcaaactccttactcattgatgtttgaacgtaggaagcttgtcatttttgcaattcttatttcttggaaagaataatcttgaaagtgatagctcagtgaaatagaacttggaaaatgacgatggctagtgagatggcttgtccctgataattaaaacacaaattagatcttatcattgcatcttggcctttggctatatagctatatatagaatgaaacaaaagaatatatatacatatatatttatatatgtagtataaaatagtcaaaatagatcttattatagccaattgatcttattgtacctgaaacatttcaatggctttttactgctctttggaaaaaattacaaaatacaaaggtctaccagctccactgcctgcctgtcttgacttcatctcatactctccccttggtctctgtgctggccacactgacctttccctctttcttgacatagaagacacattcctgcctcaaagttttcatcgtgctgttgcttctgcttttgcccaaatctctgcaagcccagctcctcctaatgactgaagtcttggcttggatcaccctaataaagtctccttctctgcctagttatacctgtgcctttgacttattttcgtcctagcaattttcattatcagaattattttttctttttaaaaatttgtcactcagttattatctacctccttctaagggaagtcctgtaaggcagggagtttaactttcttgcttactgtcatattcttagatcccaaaaccatgcttggcatgaaaaaagccaattgttcaaatattcttgaatgaatgaatgaataatttttaagggaacaatgcctcagttcatatggagggcagtgggcgaggcttcctagtgttacagaagctggaaagggcactggcagcctgtgtgccagtctgggaaaccaagggtggagccagagggacaataaagatggactgactacgatgaggaagatgggaatgtgggggaacggagagagcaagctgatgtagcccctggaagagtatacttggcctccactgtgggaatggcagctcagtaacgtggaatattccacatgaatgtcccatccagaggcttcaggctcagattctgtaaattccttaaatccaaccatctttagattctctctaggcaactcaagcttgagaaacactggataactttatttgaagtccaatgttgaattgccaccatggttcagggcggggtgaagggaggtgaaaggagtggggggatggagagagtgggagggagggagggagagagagaaagagagagagagagagagagagattgagagaaggaaacgtagttgttagctttgcctccacttgagataacttttaaactcccagaaggatgggaattttattatcgatttcccctgaaaatatcagaaaaaacaggaccacaatttctcctgattgtcaagactacctatatttcaaaataatctgtatttccaaatacatctcgtctcttctcctcagttttcttttttggaaaaaaacccctcatgttatataataattttgctgtgaattggtttgtttattctctgcagttcataaatatgttgaaggcttcactaaaatatgtaaacaggatgcgaaacgtatactaaatcttgaaattaaataattccaaacccaaactgaggtatttaaattaatccttacctaagcaaacctgggcttatcaggcacccttccttttagtatgcagatcaatcattgaactgttcatgtttgcaagttatagctcttctttttagggcaaatgtattgtgcctgctttccgctattaccatgagaaacaatagcatgttgtcctaggtattatagttacaagttgaaagacagcaggaagattgatcatgattgtgttgtagttttacaatatgcgccttttctgcaagtatgtgtgtgtgtgttttgtagctgatgttaatgcatctgttaagagttgcaggaaatttgtgtttcagtcatcaaattatgtactgtgtttttcattaatgagataaaatgtaaatatcattaagttttcatagattttaaaactcagcattggtataaagatattcattgaaatattcagctactctacaaatttatagtccacttttaattttccaaggaagaccgggatatataaaataaataggtaatccctaagcatcattttactctaaagttttagattttaagctcattaaaacattgaccaaaatggcaagcagataattgtactgctaagctcagtgttttttcaaaccatacgatgtgacacattagagggtcgtcaaatcaattcagccaaccaagagtcacattaaacaaaatgaaacaatagaatagaatatcattgtacatataagagcacatcagagacaaggggtttcttttggggacaacgaaaatgttctaaaattagattgtggtgattattgcacaactctgaatattctaacagcactgaactgtgtactttaaatacgtgagtttatggcaggtgaatatatttcaataaaacttctaaaaatggagggaaaagtaaggatcatttcaggaatctttttttcaacatgtatgtgtgtactaagttgttttgttaaattattttttgctatggagcatggtcaaaagtttgggaaatgccagtctagcaagtgggaattttactgcaggggaaatagttgacataaagatgtacttgcgtattaggcactccgatttcaaagatttactcgtatattggtcaaagatatacttgcatattaggcattcggattttaaaatttagttgaagcttatcagcaaaaccagtatcaaggctgccctgactgtcatgctccctgtcttccacagcgggagtcgtgtgaggttggctgtagcagcgcggaaggtgcatatgaagaggaagtactgggtaagaggacacacacgacttttaaaaaataggctgcaccactctagtgacttgtacttatgtaaagataacgaaacacctctcaaaacatcttgatttctgcatctcaatatgatcaaaaatatctatttagagaattcaataatttcaaacgtataggccattctgataaaattcagcaagattcttctttcagaacaaaacagagtaaacagtacatgactaatgtttaggaccagattttgtcctcaagttcagtaggtacactcacttctctcttaatgacagacaaatgtacatcctgagcagacttgatgtcagagaatgccagttttttttctctcttttttatttatttatttattttattatactttaagttttagggtacatgtgcccaacgtgcaggtttgttacatatgtatacatgtgccatgttggtgtgctgcacccattaactcatcatttaacattaggtgtatctcctaatgctatccctccaccctccccccaccccacaacaggccctggtgtgtaatgttccccttcctgtgtccatgtgttctcattgttcaattaccacctatgagtgagaacatgcagtgtttggttttttgtcctcgcgatagtttgctgagaatgatggtttccagcttcatccatgtccctacaaaggacaggaactcatcattttttatggctgcacagtattccatggtgtatgtgtgccacgttttcttaatccagtctatcattgttggacatttgggttggttccaagtctttgctgttgtgaatagtgctgcaataaacatacgtgtgcatgtgtctttatagcagcatgatttataatcctttgggtatatacccagtaatgggatggctgggtcaaatgatatttctagttctagatccctaaggaatcgccacactgacttccacaatggttgaactagtttacactcccaccaacagtgtaaaagtgttcctatttctccacatcctctccagcacctgttgtgtcctgactttttaatgaacgccgttctaactggtgtgagatggtatctcattgtggttttgatttgcatttctctgatggccagtgatgatgagcattttttcatgtgttttttggctgcataaatgtcttctttggagaagtgcctgttcgtatccttcgcccactttttgatggggttgtttgtttttttcttgtaaatttgtttgagttcgttgtagattctggatattagccctttgtcagataagtagattgcaaaaattttctcccattctgtaggttgcctgttcagtctgatggtagtttcttttgctgtgcagaagctctttagtttaattagatcccatttgtcaattttggcttttgttgccattgcttttggagttttagacatgaagtccttgcccatgcctatgtcctgaatggtattgcctaggttttcttctagggtttttatggttttaggtctaatgtttaagtctttaatccatcttgaattaatttttgtataaggtgtaaggaagggatccagtttcagctttctacatatggctagccagtattcccagcaccatttattaaatagggaatcctttccccatttcttgtttttgtaggtttgtcaaagatcaggtagttgtagatatgtggcattatttctgagggctctgttctcttcattggtctatatttctgttttggtaccagtaccatgctgttttggttactgtagcattgtagtataatgtgaagtcaggtagcgtgatgcctccagctttgttcttttggcttaggattgacttggcaatgtgggcatttttttggttccatgtgaactttaaagtagtttttctaattctgtgaagaaagtcattggtagcttgatggggatggcattgaatctgtaaattactttgggcagtatgttttaatgactggaaagtataggcatattgtattgaatgcacctttcattattcagctaaaagttatcctatagagtgcgtactgtgtgtatgactccccaaaaggctctagaaatttgtaaaaggtacagaaggtatgcttctcagtgttagattttgagcaagtagggggcttgggtgtttatcagctccctctgcctgatttcagcataggttgggcatgtcaaagtagctttgccttagtgtgttaactctctagtagtttctaacaggccagcgctttgataagtcatggcttggatgtcagcagatatcatttccagaattccctagggcatcctcccaccgagctgtagacagttcccttaagtctgaaggatgcttggctcttccatatgttgtagttcttgactcagtggcttgttccttgctctcagtggctgatggaaattggaaggggaaacttatcttgctgttctgatttgcttctgccctttagtgtcccacaaaagacaccctagacgtttctgtggagaggtagtgatattacatttttttttttctgtgtcacgggaattagctgtggataaaatgtatattttatgggggtccaagctgtgcactgatgtgctccaggccattacagcaatctcatgaggagccatggagtattttagacactcaaggtaaacacagagatatgtgaaatctgttggatggtgatacccaatctgatcataagattggaggagttgtgcagtgcccaacaggtacacaggccccattagcatgcaattatttttatttaaagatgaaataaatatacagttttatctttcaatttcgtatttgtttcaaatatctaccaaattattagataccaaattgactattaacacatacttattaagtgatactacttaaaaagtcgaactgttagagaattcttttggttcagggaaccataaaaaaatttctgagaaactaaggacaccagaactgaggaagtgtggaatcttttatttacattcctttattatattctaaaattatattaccaacttaattatacaattctgttagaatacaagtgtaatcaatgctttatttttattttctcattggctatggatcaatgtctatgtaccactaacaaatgagatgtaccaagtctaaataaagacatttgtacttaaagaccatatctatagtctgttataatgaatcctttcatccatgatcctaagaccttatttgtctttaacacatctgatttctaggtcatttatcggtgagtatgctatgttcactttagatacctcccatatctcttttcacatgatggaaaatggtaatagctaataacatattaaataaatagctaataacataataaataaataaataaacatatatatttgcatatacaaaatatgtatgcatgtatatgtgtgtgtgtatatatatatatgagagagagagagagagagacagagtctcattctgtcacccaggctggagtacaggggcacaatcacagctcactgtaacctcaaacgcctgagttcaagcagtcctcctgcctcagcctcctgagtagctaggcatgagccaccatgcctggccaaaaatagctattttttattaggcatttatgagttgaccacttttctcattaattaatatgtattagctccttttgtcctcagagttatacatactattattaacctcattttacaggtgagaaaattgaggcacaaagtttacatacttgcttgaggccacatagctggtaagggatatctctgaaagtataacccagctgcctggtaacagagccttttcttacccactgtgccatgtactgaaaataggatggagctcagtctagcttccctttttcatttggctctctctttgccttgatattttagcataaacctactttaccttttttttttcatatgtatcaccatggctttgaaatatgtctatgtttagctatgatatttacatttacttgtacttatataactgatcacatctgcccagttctcaacttttgtcatttctgatgcctcctggttatttttcctcactctgctgacaactccatcattggactccccttcaaggtgtccacagcatacctaattcctgctattgagagtctcacaacaagaaagggaaggaaaatggagctgtgctttgcttattcagttataatagtcaaaaatggactataaaaagaagaataagcagagaagggttgtgctaggcctctttgtgggctaggtcctcggatgacaatggccttgatttttctggattacagagtatagactttatttggtccgtgtctggtgttggtaatgatgagaattgcgtcaattttctcttaaccagagtaaggtcccaggagtttgtaattaaccattttaagctccctaccaaatttaccatgctttctcaaccagagtgctgattttgtttctataaaagaaagcagaagcattaaattcatcacaattttggaaaaatataaaaagtagagtaaaatcatttcatcccagtgacataccattcagaaatctagcccttagtaccatgcctggcaagcagcacctgagaaattgctgccaattgtaatacgtctaatgtttagatgtcctgaaatattttataatgtgaaacagccaatcatagtgtcctttggagtaaaggcaattgctctgtacatataaaaaataatttcttgttaagatgcacagcaatagtagaattagagtataaaatttcagaaatatattggggtacacatcccaggataatggatggttctgttgtgccacagacatgctctgagcattggctccccccgcctgtaagagagtggtattgaaagagaaaactggacagctcagaaccctctgtgtcatctgcctgtaaaagcaaaacctgaacaaaaaaatactgtgttcaaagataacaataaattctgtggaaaaaagactgacagactgactgattgattttttaaaataaactgaatatgcataccattgattattcaagtgagttattgtggcaagatgcagttttagcaagagaatacggagagccctagatgagagaggcacacactctcttgcgctgatggacaggagtgcgtggtgagtgaaatcttgttttttccccagaaaatgcagacctaccaactgctccctttgcttcttccattggaagccacaatatgacattacgatggaaatctgcaaacttctctggagtaaaatacatcattcagtggaaatatgcacaacttctgggaagctggacttatactaaggtatgaaaggctgcctttgtacctcaacccagaccccttcccaatttttttttttttttgagacggagtctcgctctgtcgcccaggctggagtgcagtggcgcgatctcagcttactgcaagctccgcctcttgggttcacaccattctcctgcctcagccgcccacaggcgcccgccatcgcgcccggctaattttttgtattttcagtagagacacggtttcaccgtgttagccaggatggtctcatctcctgacctcgtgatccgcccgcctcggcctcccaaagtgctgggattacaggcatgagccacctcgccctgcccccaatttttaaaagtgccaaattattacttataagcgtaaaggccttctagaaaagattcagctgtaagatgggtagttgggttcagatgaactttaatctcagctgctctgtaacatgctaatgctaagccttaacattaaggcttattttatagggaaaatatttattttataaggaaaatataatgttggacatatatactattccttcagtacagcatcacgtaaccattcacctcattagtcattatctgcccatcacagctaagatgagtctagctaggatggagggcagaagaaagattctcatgggggttgtagcaattcagaagtacggtctatggtggtcatccaggactgtgtcttttagggaagcatgagaaagtttagaaaaaaaaaaaatagtcccaagatactatgtgtactaacatagaaaaattcaagtccttgaggtaaatgccaaataattgaatccataattttgctattttgaaggggagaatttctgagtgaattctgcacgctgatatctgaatggcttagctctaagctccaggcctcttatttcatcttctctgttgagccatccatcttctacaaattaatctatgctttttagtcccaatgtggggtgctgattctataatgctgatgattgatcactccttgatctagactgtgtccagaccgtcctatgtggtcaagcccctgcaccccttcactgagtacattttccgagtggtttggatcttcacagcgcagctgcagctctactcccctccaagtcccagttacaggactcatcctcatggaggtatggtgtgcacacatttcttatgaaaggacattattccaaagctttgatttagtttgtttttattttaaacaatgaaataaatctattccttcctattaatcgatccattcaacaactgggtacataactatgtgccaggtagtattctaggtactcacaatacctttatgatcaaaagagacaatgacccctgctcctgtggagctcactttcttttttcttttcttttctttttttttttttttttggagacagagtcttgctctgttgcccaggctggaatgcagtggtgtgatcttggctcactgcaacctccacctcctgggttcaagtgattcccctgcctcagccttccaagcagctgggactcaggcatgcactaccatgcctggctaattttttgtatttttagtggagatggggtttcaccatgctggccaggctggtcttgtattcctgacctcaagtgatctgcccgccttggcctcccaaagtgctgggattataggcgtgagccacctcgcccagctggagctcacatgttgttggaacagaaatattctgcaataaacataagaaataaataaagtatattgtaagtgggatggtgctgtgtgctatagtaagaggaatattttgagcagggtttgtcatttagaggattggaaatgaagagtgaagagggaaggagaggccagtggcagtatgaaataaggtggccagaatgagccttggtgagctggtggggtaaagtttgagcaaagacttaaaggaggcaaggaagtcaaccaggcagctatctcacatagagagtttcaggcagagggatggtccgtgtggaagacctaaggcaagaacatctgtggcctgatcaaggagcaactagaaggcccacgtggctgaacaagagtgcaggaggcagaggagtaacagctaaggtcagagagatgggggccagacccagtctacctcagggatcttggtaaggaatgtggcttttattctggaaggagagtcactgtaaggttttgaggagaggagtgacacgatctgatgcgaactgccttatacattaaaaggaaaactggctgctgtatggagaatgaactctggggtgtgggaggaagcaggaagaactggtaggaagccatgtggtgacccaggtgagaggcccaggggtggtagtggtgtggtatagatatgtttggattctatttttatttcttgatgtaattttagtctttttattgcctaggttataaacttctttggctgtggaaaaataacatcagtaacaaaattcacctcctgtttttttttttttttttttttactgaaaagtttgttattttttgtattatatttttaatataattgaaaggaagattgcgcacttttttcattcattcaagtatttatcaaggactattatataccagacattgttctaggaactaaagatgataaaatcctaacccttatggagcttgcattccagctagggaagacagtccgataagtaattaagtaaaagtattttctgggttatgggaagacccaatgaatagcatccttcttcttagtctgaattctgaaccaataaaagataaaacaaaaacggccagaagatggctgcaggaatgtcaatattatttctgataagggccaaattgtatgatgatagattttaaagtaggaagtgcgatgtgacacatagccagagacttggtcgcacagggccatactgaccctgataaggagtacagattttattctaagtgggacagaatgtctttggagtgttctaaggaggggagggacttgttcaaattttaaaactttcagtatggctgatgcatggagaatagactgggagggtggaaggagggccagggaagctggggagctgttaggaggccaagcaagtcaggcttgatttggtgatggctctgacaaggatggtgatgggaaaacagggaaaggtttgtcatatattttgaagattgagctgttggggtggctgaatggatttggcaaggaagatgggaaaatcaaagttgctaacttagactttcagtctgaacacctgaatgtcatcatttactgagacagggacaagggtaaaggaggagtggctttcctagataaaatcgtcagttctgttttggccaagcaaaatttgagatgtctgttagatatccaagtggagttgctgaggaagcaattaaatggaaggatttggaactgaggaggtaagtcgaaggtatccaaactaccaatttaggagttatcaccacggagatgtgattcaagccatgggcctggaggcaatatgctgaaagtgaatgtggttgaaaaaaggagaaggtcaaggtgtcagcccaagggcccttaatatttggtggctgggaagaagaagagggacagcaaaggacatggagaaggagagactcaggagcttgtggtgtctcaaagccaagtgataaaagtgtttcataaatgaaggtgattgagtatgaaacagtgacattatctctggaaagcaacaaaaagcttcttatctgctagattcctgcttcctcattttcccaccctttatacagaatgttgccctatcagaatataactttatctgagctgctgtcctctgaatactaatatatccttagagcaattctagctctaaataaatgttattgttctcttgttcaaaatatattcatgggatatctatagatgcatggatactttaagaagcttactcccttgtagaagagataaagcacatgcctaactaacctcatagtaaggtaaagctttattaaacacatagaaaacgtactgacaaattcccatggaagtttagaggagggaagtatttatttctgaaatgaaatatcaaataaatctctttggaggaagtctcatttgttgagttagacatgaggtgaggagagaaaagggcaggtccaggtgtctatgtgaccagggtcaccaagattggattctaaggcatggagggaaattagtcagtatgccatctgctggaagcatagaatacaggaagaaaaatagtgagaataacactgggaaggcagactaggtccagattaccaagaatcttaaatgtcctgggtaaggagtttgtactttatttagaatgcagttaggagctatggaaggttttaaagcacaatagtaattgcttcacttgcttctcaaaaagagaattttggcaactgcacatagaatagattgagagaatgagtgagatttgaaagtacagaggtagagaccagctgggaggttactatattattttaagattttatcaaaacagctttttaaaaacagaacatatattggggtattctctgacttattattttgaagatgtgacttccacaccaggaaaagcattcaagcctagaagccttagaggaaggcgaatgctggggcagacaccgagggagagttgtctggtgccctcaccctcagagttagctgaggcaacccaggaagacatgctccaggctggatgccctaaccctcagctctggagatgtgcctatgtgcagagagcctcaggctgaactaggccttggacctaagcagagccgagcagctgatgaagtgggttggggcattttcccccttccctgatggttgctctctccttgcttgtcagatctcagggtttgtgtggccacctctgctgattattctgactattcttgcttagcgcctcagaccaaacactggcctaggaccatgttcgaaattttccagatcagaggagaatgaattcttccttgttccaagcaatgccatatgttatccaacagtgctgggacattttccggtgctacagaaataccgtgcagggacattggctgggcaaatcaaaataatgaaaacaaattttgctgttcatttctgggcctttctcctggataagcaagctcacataccctctgtgtcttctagaccctacatgggtgtccttcttatggatagcatctcatgtttctgattctcacttttctagctacatcaaaacttagaaacttatctgtattgtgttaattgcctcataaccctattctcttttagctgtgggaatgacatgattttagatggtgctattgcctttttttttttttttaagacagagtctcgctgttgcccaggctggagtacagtagcacgatctcagctcactgcaacctccacctcctgggttcaatcgattctcctgcctcagcctcctgagtagctgggactacaggtgcatgccaccatgcctggttactttttgtagttttagtagagatggggtttcaccatgttagccaggatggtctcaatctcctgacctcgtgatccgcccgcctcggcctcctaaagtgctgggattacaagcatgagtcaccgcgagtttttttttttttttttttgagacaaggtctcactctgtcacccaggttgcagtgcagtggcacaatttcggctcactgcaacttctgcctcctgggttcaagtgattcttgtgcctcagcctcccaggtagctgggattacaggcatgcgccaccatgcctggctaatttttgtaattttagtagagatgggtttttgccatgtaggccaggctgatctcgaactcctggcctcaagcgattggtccacgtttggccttccaaagtgctaggattacaggtgtaaaccactgcacccggcctaaatggtgctattgccttttaactgggtcttttcagaaaataatttcttaacaaaggaatgattgtcagacaagggataccagcatttcagggatgatttttgtgttgttgtttttttttcggtggggaagacctggacaatgatcgcatcttgccatgtaggtgacatttaacttgcttcaatggtggaagatcacatttgggcattgaccctaatgacttaaaattttgacattctaattatattataattcagtgggagaaatttatttcttccctgtttatcatggtgactgactacatggagccgaggagtgatgcaatgatgcttgtgtttgctgaaaattagtctgagagttagagatgaattgcatcagagaaaggctgagagagcaattaaaagggcttttaaaagtcagtggtgatgcagagcatttgccaaaagtgttcagagggagagaaatctactcaagagcaaagtaacttctaattgtgtctttctatggaaagaggagagaaagagtctggttttaggggtttggtttgaaaagcaggtggagacacagatggaagctaggctgtcagatcatttgttgtcctttctttttccacttaagtagctgctggggactgtgtgtgaacgctcagttgtttcatacatgctcctttaatcctttgccagggcaggggtgctgaagctcagtcagcctggatttccaggacctgagagctggggtaaggaaaatgtagtctgggtcattagagctgatgccaacaaaagtgaagccaactgttcgaattccagcttgtctgaacccacatctccagctggaaccagcaaggctgccccactcaaatgagtgaaaaggccccaggatggacttttttttaaactcgtcgatcattgactccagttttagtcagactctcctcttcttcctaaactggttccatcccatgtttcaactcatttaagtctctagagattcctgatgactttttttaaaagggccattattgtattcgtatacactatatttaattttatttcattaattagaagtgaggaaagtaacatttgaaagggcctcttgggaaaggagcgaactggtttagacatcttaccacctttcctctatcacatattttgagtattaataaaattatttcgtttccattaagttttcaaaaaaaaaaacaagacttttttccatcttattttaaaaacatcatgcttgcacatttttctgctcattatgtcaccattatctcttccagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggtaagaattaagtgatacagaggaaaatgtaaccagcatggctgcaggcatgataattatttaagaaatatgggtatcaaatagtttaaatgtgctttgagaagcgccactgactccatggtgttgggttgaagtcattgtggttttcctcaggcttatatgcctattagattatagcatcctaagcaaaaacattctcaagtatttctattatattcagaggatacttataaatatggctaataaagacatcgtaaacaccatgaatgtcaaattttcatttaatccaatatgaaaaaagtaaggaggtagagttctgtttaggcatttttattaaccattagggtaattattttattattgttagcttttctatcatttactagagcctctttaaattcggagaagaatgggggtcatgcagatagcagagttcagcttttgacctctatgaccctgaactgttctaggggaatgcaaacaaggatgtgattgatggtcatttcggtgctgagcagtggcaccacgtaactagactcatgcattgccacatcaccctttaaatagaaatgttattgctccttctatttttatctcatgttcacaccatgccatgtgaaacacgtctctccaaattgtttttggaataggttttctattgcagcagtaaatgaagttggtgagggtccagaagcagaatctagtattaccacttcatcttcagcaggtatgggtcaggcttcttcctttagctacacaggaatgagggtggcaagggtggtttcagagccagaagccctgggtcacctggtagacctcaagacccacctcttctgcccaaatgattattgtcttttgggtacttgttaagttttccattttaaatgaacctaagtatttgatgaattaaagtaagtggttagatattagaatttgggaattgaaaatcagaataaaaaatttagggttttaaaaaaatggcctcaaatctttggtttcagttgaaatcactagtgtttctgactcacatttacacacttaagggatacatataacttttctgccctaatccctattttagattatatataattatttaatatatatcagacattgttttccagtatctttgtttttaaatatatctggactttaataatttacattttactatataagtattcagtctgccaaagtatcttttattattttgtaagcaccctttctttttggctttggtgttttattgattacctcaagtgactgaatacttactgtatgatatatgtgtgagcaaaataacaaatgaaaatgctttctaagaagtactggaaatttgaggggaaactaataaaagatttttgagaacatccaaagattcacaattctgggagcctgttttctatttttactagaaccctatttgctgacttgactgccccttactctaatctgtacatgcctgtgccaatgggtattgagtgtcatccatcatcagcctttgtttttttggctgttcctagactctaggaaaggagaggtatttttgttatgtaagaagcacgtccaaagggtgagttaaatatagagcagggttaaggttgttgttactgtgattattgcataacattcattaaataccctaaaaatgttcacccatgcaccttgtgtcagtctccacttgaacaggatatcaagcagagttctgcagccttccaatgtcattcctttaaggacctttcttctgccctaaaggcaaagatactgaagacaacacagagacaaccagtgtctgacaatatgtgtgtgtcatgcataacccactctggcctggggtggaccacctccaccgagccaattctcatggctgaaaataataagctgagctggggcaaggttgttgagaatagtgatacatcatgtgatgtcatttctgggttatttaggggcatatgaacataaatcctatttgattgttactgtacttcctacctccaatcatagaataatgtgagttataccatagatgcaattctccagtgccattagagaaaatttgaccagcctctttcaagcactagtccccttgctttgaagggtagtactgatcttttttgtgtctgttagtgtacctgtggttggtctacctgtctgcaaattgtgttgtttttttcagttcaacaagaggaacagtggctctttttatccagaaaaacttctctaagaaagagatctttaaaacatttagtagatgaagcacattgccttcggttggatgctatataccataatattacaggtcagtatgataaggataaatgattccttagtgtgaaaagaagattctaaaagaagtacttctagaataaaagaaaatttttgaatatttctggaacatattctcttaatatcctaatatattagaataatttagaagaatattttcttttaaaataaaatacttctattttaatttattaatcattaaataaataaattctcattcatacaagttttttgtcctggttgttatataataatgtgtgtgcacttgcatggctcttctaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggttagtccgagaagttaaagaggaatagtgatagacagtgatactgatatgcatatcttggtatatttaatactaaacacaattgccttattcaatacatactcaagtatttactatgccttagatactaggttatcaatgaatcatagatctggcctataggagggtgtagcctttacctagtgctagtcctgacatagcattaaatcacctttatttgtacttttttagagtcatgagtttatactaaaaataattcatcttctataagatagtggtggtacctgtcttattgttaggtaagactgccagtcatgatcaaagttagctgcaagcatttaaaattatatcataaccagagggaaatttagtagttctccaaaaacacagtagtactgtacttttcggaagaccattttttgttgttgttgttggtggtggtggtgcataaggactattttgagctgatgaagacacagtcttgacatgtttcaaattctacttctttggaaggtacaggcttatcacagtaagcaacagccattgctgtggttgaaagtgcataaacctagatatcgcttaaatgttaaaaatagttgaatgcctctacaagccaggaaaataggcacttgtattgcattgatgtcaataatgtataaattcattaggatataggatataaaactgtcgtttaagggcttttttttgctcatttgtcttgggcagtgctcagtgcctagtacaattccaacagaacagatactcagggatacttgttggctgaatttaatgctgtatagacagatgctaatcctaccggtatattttttatttttttaggtatgtgtctgtgatttagagaactgctcaaacatcgaggaaattactccaccctctattagtgcacctcaaaaaattgtggctgattcatacaatgggtatgtgttagccttgtaaagatgaattctcttccattgggaataaataatctttgagaaacttgcttgctaatgaaacattgtagtaccagatgagcctatctatgcatcttactttaggtgaatttaattaaattcaggcaaagttttcattctgtagagccaggagggaatgttttttcaaacataaatcaactcttataaagtagttatttctctctccttcacagccaaatatgggaatatgggaaagacctcctgtctgggagtcaggggttgggttctagtcctggatttgccacttctttatcatgggattgagtctcactttccgcctcaacactacctgtgataaagccccttcattccacctgttccttttgctgagccattcaactgtagttcattcctctggtttggttctcacatctatcaagaggttctttaataagaaagctgctagcttccaccttaggagacaggagctgattgataactctgcctcctacccccaaatgaaatggacacattgtaccgcagtcttgctgttaaattggagtagtacctgaagcaagtaatatcatgtctatgaccattgatttatcaatccatatagggaaggtaataatacttacccagttgggttattttgaagacaaaatgaggtatttattgtgcatgtattttgtgaactccagatatatatgaatatgaaggataaacacatagaaagttattttggagttattatttctcagatatgaccagataataacagattagtaaccagtaggcaaagcccatgtttgtaagattaaacttttttctttcctgtaggaataaagttgctttcattttgaatgaaaaaaaaaatacagctcataacatgtttttcacaaacaaaactttcttttaaaaaagattgttcattatagattttaaaatcaagctttctattcctattcattcacaatttactaaagatttattttaacttctaggtttgaatgaattactgaattatggaatatttaatgctttgtgatgtaggacaaggattctctggatcttactgttttcatgtgtaaaggtctacggtcctatgaaatgtaactttgttgttgacacttacacaaaatgactcattctgaggataatgaactttacccactaatcgatcattcaaatgcgatcactgaggtcttcagtggctctttttttccattaggataaaatggatttgtgcttagattttgcaatgtgactagaaatgataatgataattagtatttatactgaatgtgtgtttctaagtgtattatgtccaataattcatttaatttgtattcaaccctatgaaataagtacttttattattctagttttatagataaggaaagggaaacacgggttgattccgtaattgtctaagattatacagctgttttgcgatggaaccagtggaaccagacaggccctggaacaagaaatcttgctccaggacttctagctccagggcctgtcttctaaccatctctctataccatgataggagagtttctataaaaatcagcatgtaactttcagcaatagtttgtgtttagtagtcctaaaggacatcagatgtgtgaaacagtgtattgtcctggtattagaaatattttcctctatgctgttctttttgcactgcaaattgtctcctcattgagttcagacttactgtaaaacctctgcttttcttcctaccaccacttccccatcttcttccaccccagcttctcctcctcactctgtcctcctcttcccatgcaccagatctcttcaccttttctatttttctttctcttcctccctgcttcaatataataattgtaatatttaccacagatagttttccttttatctactctgaaattcctccaaattccattaacaattttgaatttaggaaacaaaagcagaaaattaagagccaagctgtttttgctttttgcctgctacaatccgtcctcagggaaaagaacatagctacatatctcaaaatggagcttatatctcaggatattattctagcataggagttttgagaaaattgatcaagatttggaatagtcatcaaggggaattagagcagaactaaataaggacaaggaaaatgatttgacagttttgatgagaggttggaatgctgccagtccttggggttgggataagaatttatcaaagtatacttctgttagcacctttctccataatcacgaattgtaaattagctacatccacattaatggttttatattttagttaaaagtttatttacatatttcattgtcaatgaaatattttggcagtatgttttctttttcattattaaaataacctgcctcgttactgtgaggtttgactttaaattagatgtgcttctctaattcttccgttggcttctttctcctgattgctggattttcctgcttcagtcatgtgtggggtatttctttgtggtttataaaatggtagctctattgcctgcatcaattgtagattaaaaaaaattagtccactgcaaatgcaaagtagccatgctagttatagcaaaatgataactgtacaattaaaaatggtttaaatgttttactttcttccatttatcactcagaatgcatgagaaaatttactgataaaattagacttaaggatgtgtgttttttggaggaaaatgtttgatagtaaataccatatttagccatgtgatttctatatagtatgttttcctttaaaattttgaaagacccttcctggccagggctggtggctaatgcctgtaatcccagcactttgggaagccaaggtgtgcagatcacttgagcccaggagttcaggactagcttgggcaacacggtgataccctgtctccacaaaaaatacaaaaattagccgagcacggtggcaagcctgtggtcccagctacatgggatactgaggtgtgggaggatcacctgaacccaggaggttgaggctgcagtgagctgtgattgtgtcactgaactccagcctgggtgacagagtaagaccttgtctcaaaaaaataaaagacccttcctgtttttgaattttttgattccttaaaaagtcacttataataattaagagactaagcattacaagtgaggctgaaattttctaatgttccaacttgtaacttaaacgaatagagtatatcttaggaaattacctttttctaccttggaaaatcctgtacttagcaacatcagagatacatagttctgattgtgcaacagaatgaagcaattagctgaggaggttactcatcaacctttggactgaatctcatgaggtttcttttgttcctgtgtcaggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccagtgagtgctctgtccccagtgtggttactggccttgctggaataagaggaaggtttgaactgcttggcgttgtgattcaattttgagagccccatttggctattcagtcatcaaccagaagcagctacttagctaaaaaaaaagtttatacatttgttctgcatttattagttttacattaggagaatctctatacttctcatgtatatcccaatagaataatttgaacatttattgagtgtctgctaagatccaggcattgacattctagtcagaacaaatagccagggagatagaatacttgggttgagattttttgtgctgttgaaagcttgcatgaatttcagcaattccctaaaactctgaactcgaatctccatctctggagagaggtagtatgtgggtgggtaagcaggtgggctctggagtcagcctgcacggattcaaatacttgccatttgttaatagaatgaccctgggcaagttactaaaccactctgtgtctcagtttccacacctggaaatggggaatatttattatatcttttaatggaactgttgtacagataaaattaaaacacattagtagagcacttagaacagtatctagcacagaggtcagcaaactttttctgtaaaggaaagaccagatagtaaatatttttatttactttgtgggtcagatggtccctgtcagctactcaattatgtcgttgtagtgtgaagacagtcatagataatatgtaaatgaataactgtggctgtgttccattacaactttatttacagaaacagtgggccaggtttggcctgtgagtggagtttgccaatccctgatcccctagacgatagtaagtatttagaaaacattggctgtttttgctttagaacaaagttaattatgtctgtttgctgcatatctcaaagatggctgaaaatgaataggtaatttttttttattgattgggcttcttggaggaaggtactatacaaacagtggtaattacattaaaggttcatcattaagcattttttattaagagcctgattatatctattagtgttgtagagaacccctctgacaattatatgcagcaagcatatagctttgactgaaggacagtcctatttgttgggaatgctgtctccttcaatgcagccaaatgagcggcatgaggaatgaacactgtcctagcctcatcaacaaatgatccctggtgattatcggggtagcggatattactgcccaattgctctcccatttgagatgaggctgtaggtgaatttatggagaatccttggtttgcccttgcagatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccaggtgagaaaatgttctggatttagggagtgactctcacaaaaagaggactagctgagtgccctttaaatttccttgccttgggtttaaagaaatgagaatgagggtgtattgacctcttgagtatgtgtttgagtaaacacatattgagtacatatttattttctgagattaggaaagcaaataaagcactgtgtgatatttaattagtgtttctaacctgccattttaaactttccaagatattttttaaggaaacactataattgattctttacgggtttcttctttcttatggtatattaagcagtggcatttctgaactctgagggtcttgctgagagaagttgagaggctgtgaattatgctgaattccatcctcttggctgaaaagaaatggaaggatgactataccattcatattactattgttaacacagtctcttctggatgctctgaatgagaccatgacaaacagtagtcaaagccccctcaaaaaaaattctgcaatgatcaagacaccgttatagaggcaatctcaccatgcgtttttcttcacatttcaaaaatttatgtgaaaatcagaaagtatgtttaatgggatcattcttgttacacagataacaattactcatatccttttatagaacttttcaaagtgttgacattcttttactttatatagaaaatcataagatataaggcatagatataagtatataagatacctttaaagagtttgctttccctgatgtttcttttaatttcttttttactaaacagctagtgaaccaccatttatcatggctgtgaaagaagatgggctttggagtaaaccattaaatagctttggcccaggagagttcttatcctctgatataggaaatgtgtcaggtaaaccccaagtcctctgttcacttgaatgacagatttctactcataagacttcccacatcattcaatgaatcaaaagaatagggtatttttgtatttggtcaatagtgaaaggaaaaaatattgactgaactctactgccagtgattctgttaagaaaatgtcagttcttagataggaacgctatttattaagtcacaaaatgtgaggttgtttctagttttatgcccaccaggaaggctttgatataatgctgatgtattaatctaccaatgccatctcacattaacagcctatcttgttccactaagacagttatacttaaataatttactgtgcatttgctataagacaggagcagaaactgctgcatagagttctaaataaggtataaggaataattggttgacaaagaggattattaagtaatgaatgggtaatttgcctggaaggcgttagaaggaagaaaagtcttcattctagggtgttataacagtgatcttgcctgaagatgacatcttccatagttatctaattgtttattgatttatttggccattaaaagtacaacagcatttctgaccaacataggagccaaatgtaggtaatgtggcaccaatggagagaatgccactttggcattggctgagtctgggcttcctcttgatgtatctgtgagccctcaggcagaacacatgatctcaccttgtctcaggtttaccatctcaaaaatgagaataattcctacttcataattttgttttaggaactaaatgagatctgtaaactgcctgggacaatgtttggcaaagaggagatgctcgatgtgtatccactgttctccctggtttcaggggttaagagtttgggaaacattatttaaatattcttgacagatcaagttctagtgaatatgtgtcagtgtgttgtttaaaattatgttgaggtgcagatgtgatttgttgactcattatgtttttgttggtatgtatgaaaaataactgctaatcattcactttattttgagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtggtgagttaaagcatggcattctggatgctctagaatgatacttatccacttcagtgacttgcacaccaatttcttttttttttttaaatacctgtgcaccacttatgctattatttatttaatgtttatctttaaaccaagtcacttaaacattttttttttctttttttgagacacaatttcaccctgctgcccaggctggagtgcagtggcgccatcttggcctctgcctcccgagtagctggaattacaggcatatgccaccatgcctggctacttcttgcattttcagtggagatggggtttcaccacgttggccaggctggtctcgaactcctgacctcaagagatctgcctgcctcggcctcccaaagtgctgggattacaggcgtgagccaccgctcccggcctcatctcacttttaaaatatgtttttttgtaaattaaatttgttatcactatttgttgaattaggtattttttccccaataataatttaaataaatacatgaaaatgctcacctgagcgttggttcttggcaggaacatggcatgctccaaaagcatgattcaaggcaactaagtgaagagactattttcaaaggtgtgcacagggctagggaaaatgaacaaatgatggtgaggcatcctcacggtttacaagtgtgcgaagacataagtctaggtgtgaataggcaaggggaagaagtggaagaacctggtgagggctgtagctgtaggagagtagctgatatggactgtgactttaggcacagaagctggccactatcaagatgtatggtctggcaaggagccagctaaaggaataagaaccccaacccctccttcctcctgccctctaatctgccagtgcttccattggctgaacctccccagaagccagacaacaacccttcagcctagcagataaagtccatagatgttggcctatgggggcacagagtagggtggagaagggtgggaattagacctagaggcaaaataaagacatccagcacacctgtggagtgatatattttgaagagaaagatgatggctaatgacaagaacattggcctgacagatcaagaaataaggtattgaaataatttttaatcaggaaagtacttgctgtccatttatttatttgtccagcaatcatttatctactaccaatgcgttgaaatccttgaaagaaggcaaagtagggaatataaaacaaatagccgacatgtccctgctattttaaaaacaactttgttgtgatataattcacataacacaaaattcattcttttattgtgtagaattcagagattttttagtgtgtccattgatgtacagccatcatcagttgtccctgctcttctgaggagataaaatacatatataaaataaagaagcatatgaagcaatgtatttagagacaaagcaatatggtacaatctgaattcataagtgccaaagatgtgcaagcagaatgaaattgagtggggttagtcagaaaacactccctcaaataggttagtttaaaaatagttttgaaaaaggaaatggaagagtggacataaaaaccagttttaagtattttctctatctcttattaaagtgtttaactccaggacaaattgtttaactttaatccactttacctgtgaaaaaatagggaatagaaatccttcataagcttaatgtgaggattacaggagtttatatttttaaagataaaaaagtacagtgcctggcacattattgataatcatgaaatattagggaactacactgatagagaagagcaaggagagatgtcatcatttatagggacataaacatcttttttcgggagtctaatcaaatatattcctatccagcagtgttcacattgtctggatgtataattaggaaaagcagttatttttatgcaaagtaaatttagttcccttctctttggaggcatgaaaacagataagccccatgagggcaggtgccatgcctgtttgcttgttgctgtgtttccaaggcttattacactacccagcacatagtgccaatcactatttgtggttgaatgaatgaatgattaatcaagcaatttattaatgattgcaataaatattcagaaataataatgtcacttgaaagccattaactggccatacaattatgttttttagatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtgacaaattaaaagatctgatcatttagtaatactgaatagctctatatttatgataatactttctctcgcttattgtgagtacttaaagcagactcctaaaggaaatagtgttttggtaagatcttggtttaaccaagttttctgttatttgaaaaaaaagcgccttatttgatggtcacaattgaaagccttatttgatggtgataagtgattatgtaagttcaaatgcactatggagattttttttgtttactttattttgagtgaacccaacttaaaagtattttaatttataactgtttttatagtcttaaggacttctgttgaatattttagaagctttgaatcaggtggtgactaggcattttactattttcaatcagttttgggcactgactgttttaaaaactgtttctaaaaactaggcaaatgatttcacttctccgtgtttctttccttatctgaaaaatgggactgttaactattattctacctcctaagtttttttttataaagattatatgagagtattcatgaggagtgggaatagttccaggtacaaagtaaatgctccgtagttaagctcatattattattactcaacctgcaaatacaggaatgtttctaaagcaaatgttacttttacttcctcagcttttacaagcaataactatttttgttgattctgtttagctacccactaggtatccatctaagtttctaaattttaattttttctgaccataatagtgacatatttcaactgtgaaaaacttgaaaattgcagaaatgcattaagaataaataaattattcacaccatttctacctaatatatcccttaagattttcttattttaagtcatttttttctgcagagataaaatatacataatacagaataccagatgattttaaaaatgtatgtatatatatgaactaatagttgagtcacttgatctccaattccaataacatatatgggccataattcctaggatatttaaagagacctgatttgcattacatggattataacacagacatttaaaagagatggaaatttatgtaccatatccaaagacaatcattcttgtcaaataataaaaaggtctcttaattctattttggagtcacttgagtctgaatacaaagaaagcatttttttttgtttttcaaaaaatataattgttagggaaaagcattttcatttttgtaaaaacatattgataatattatctcaagagtaacttcttctccacctcagggactttgtcagtaatcttcccagtgttctgatatggttgtttgagtactctcactagccaggataaagctctggtgtgaccttggggacttccccataaatgagtgagtcatctcagcatgtttgggggaaattcatccttcttacccctctttaaatcccccctccaaacgcttatacactgcagatggggatgtaaattagtacaacctctatggaaaacagtgcagagatttcttaaagaactaatagtatttctatcattcgatccagcaatcccactactgggtatctccccaaaggaaaagaagttattatatcaaaaagacacctgcacacatatgtttatggcagcacaatttgcaattgcaaagatagggaaccaacctaagtgcccatcaactgattagtggatggataaagaaaatgtggtataaatacaccatagaataccactcagccataaaaaaaaggaggaaataatgtcttttgcagcaatttggatggagctggaggccattattctaagtaaagtaactcaggaatggcaaaccaaatactatatgttctcacttataagtgggagctaagccatgggtatgcaaaagcatacagagtaatataatagactttggagactcagaaggagggagggtggaagttgggtgggggataaaaaaaaccctacatattgggtacatttttacactactcaggtgactggtgcactgaaatctcagcctttacagctgtacaattcatccatgtgaccaaaaactacctgtaccccaaaaagctattgaagttaaaaatatatatataataaaagcaaaagaatggaaattaaccaaaaaaaaaaaaaaacagtcctctgcaaatcctctcccaggttgtcaagtgctgttgttgcttttgcaaatctgtgttctggttccatggtttgatgtctaatctatctgactcccttagtgacagtggatgttttgaaggcaatgcattttgcatccagcaaagctcttcatctctctcttgttcattgatgtcatgtacagatttattatgcagtaataatatattttgcaatcagccgacataatgaaatacagtcaggcaattatttatagaaaggcccaattacttgtgtgataaaaaaagaatgaacaaagtaagagattcttctaaggtaaaaagataccttttgccacatctgatgagctcaactcacagcatatggtacattttaccacagaattaaaatttagcataagggttttagtttagatcagagaggtttatataaaaggtatggagtaccctctgactgtttaaatatgaagctgctgactgctgtggaggaatgggatgatgactcaacacctgaattttacttagagtttgaatagtttgttgtattccagcaaaaaattgtagaatctcctttttaaaatagatgaaatagacttaatttgtaatgtagaaactctagtgtatctcattgtaaataaccaaacaaggttaacctgatttctttttaactgaaaaaaaaaaatcaatagatctctctcagcatggagcaaggacatgattcaactcctaaaaggctgagaattgccagaatacatttttaccttctggagaataagttggttgaattttcctgaagatagaaggctgtgatttgtatgacaaccgaagggtttttgtcgtcatgtaccttataactgtttctttgtagcaggataacttttcaggaagaatttttagctcttggataccttattgtagtcttttcacatctttcactggctcatcatatttgtttaaatgctgctgtatcttgctgaagatgtagtcgtcaactttaattctattggttatacctcacagcttctaggtatgttacagggagattgcactgctccgaaatcaggctactggcaatcttagcttatttgaaaaatatttgtaaagccaaagaaagcaaaaacaggatctttggatagtaacttctatctgtctcatggattctatgccatatctcatggattctgtgccatcaggcctcatctagatgactggatgtaaacttaagatatacattgcaacaagaaagcaaagagtagtaagaagtggttctcatatgtcatctggaaatagggctttatatacacattactattcaattttaatacataaacatcctttgtgtatgatctttttaaagtgtatgagaatgttttgggttgcaattaatagaaaatacaattcaaaatggtttaaaccattggtggcacgttggaatcacctgagaagttttaaagcatactggagcctaggttccatccccagagatcataattaatagagtgcagcctgggaattgagatttttaaaaaactccacagatcattgtaatatgcagctatgtttgataacaacaggtttaaacaacaacaaaattcactggctcatgttgctaaataggccagagttaccactacctttaggcaagcttgacacaggctcaacatttcagattcagtaactctggagtgtgactgataatttatatttgttccaagcttccaggtgatgctgttgctgcaggtctgagaatcatactttgataattactggagctaagtatataaaagtgaataatacactccttgcctttttgtaaaattttaggacaccagtgtttatatccaaataacagtaataagcataatcatataagttttatagtcagaaaaaagtaaaaattactgaatttattattccaaagaggatgttaaagagaaatctatagcttaagtgtgacctgttcacaaagttatgcttcaaacatgtatttggtttattttcttaccttactttctacttaggtaattgctctaactttagacctcagtgatgggctcctgtattggttggttcaagacagtcaatgtattcacctgtacacagctgttcttcggggacagaggtaagtagagtccctcaaaggcaattgattgagaagaaaacttgtcagtcataaatgataatgcatggaaattcatttattccttcaataaacattttctggttatccactgtgttgcaggcattgggcttgtagggtaaagaggtttgtaaataactagttacagtagaatatggtaagtgctgtgatggggtatgaagagagtacagtatagacactcaggagaatgctgcttaagagcccaggaagtgtatggataagcttttctgcttcttcacaaaatagagtatacattatggagtgaaggcagaactcttcctgtgatgtcttaaatgaaaattagagagtgaaagggaccacatgaattatctccttgatctgtgtcctcaagcttatccccctgtcctgatcttgtcggtatctctacatcttccacattagcattgtcagatattttaaaaataaattttacacttttattttaaaaaattagttaaaatatacataatgtgaaatattcagatcttaagtgttccattacatcagtttagacaaatgcattttgagacacagaacatatccatcatcacaaaaaattcctgtgccccttgccaatcaatctgcaccactccagaaatatgtactttttgtatctggcttcttttacttggcatacaatcttttgcgatatattcactttgttatgtgtactagtttttcttttttattactgagtggtattccattgtgtgaagataccactgtctgtgtatccattctatgcatgtcttgatggacattttaattgcttcctaattttggttattatgcataaaactgaatatttgtatacaaggctttttgtggatgtatacttggataaatacctaggagtagaattgctgggtgatagggtagatagatgtttatattcttaagtaattgccagtttttcaaaatgtttgtgccattttacattcccataaaaaatgtatgaaaattgtggttcttccatatcctctcaacagttggctttgacaatctttattatattcaccattctttggtgtgggaagcagtaaatattgtgattttaaccagcacttccctgatgactatcaattttgatcactttttcatttgttatcagccatttatatatcttcttttatgatatgcctgttcaagtatttttctcatttttaaatgagttgtcttttcattattgggttgttctgtatataagcactttgtcaaaatatgtgttgtgaatattttgtctcagtgtttagtttatctgcttattttcttggtggtgtgctttgatgagaagaatttcatttcgattaagtccaatttatgcattttctatattctgtgctttctgtgttttctacaagaaatcttagcctatcccaaagttgtgaagattttatactccattttttctagaagctttatcgttttagctttcatgattagatctataattcatcgtaaatttattttggggtatgttgtgagatatgagttaaagttttctttttttcctttctgtagggatatccagttgttctagcgccatttgctgaagagattttctctttctttatttagttgctttgggacctttattgaaaataatttgggccgggcgtggtggctcacgcctgtaatcccagcactttgggaggctgacatgggtggatagcctaaggtcaggagttcgagaccagcctgaccaacgtggtgaaactccgtctctactaaaaatacaaaaactagctgagcgtggtgatgggcgcctgtaatcccagctactcagaaggctgaggcatgagaatcaattgaaccggggaggcagaggttacagtgagctgagatcgcgccattgcactccagcctgggcaacaagagtgaaactctgtcaaaataataataataataatttgactgtgtatgtgtaggtctatttctggactctctgttctgttcctttgatatatttgtctactctttttgccagtactacattgtcttgataactgtaaattcagagaaaaacttgaagacaggcaaattcagtccttctactttgctttgcttttccaatatttttattttggctatacttgatcttttgcctttccaaatagattttaaaatcatctcactaatttctagaataaatcctgctggaattttgaatctcttttcagtttaggaagaatgaatatctcaaaattttgaatcttccaatcaatgaaaatggtgtatctctccatttttttaggttttctttgatttctctcagaagtgttttatagtttttagtgtagatgtctaacatatcttttattaggttaatgcctaggtatctaatttttttaatgctttatatatgttactttttaaaattccattttctaaatgttcattactagtgtgggaaaatacaattgctttttgtatatgactttgtatcttatacatttttaagttaatttatatgtcctagtagatttcttctagaatactttagtaagagttatagtagtctcaaaaatgacttaggaagcattctctcctcaattttctgaaagcatttgtatagaattgctgttaattcttctttagttttgataaagtccacaagctaattcatctggacctggagttttctttgtggaaaattatttgattacaaattcagcatcttttaaggatataaggctatttatttttatttcttcttgagccagtttggtaattcatgctttcaagaatttgtcattttgcatgagttttcaaattttataatatcctcttaatatcattttaatgtctatagggtctgtcgtgatatccttttatacttctgctattggtacatttttttcttgatcactcctgctaaaagtttatgagatttatttatcttttcaaataatctgtttctggcattattgatttttttctgattgtccattttttatttcattaacttctaatcttattattttcccttttctatttattttaggcataattttctgttctttttctagctttttagattgaaaagaaaggtcattgtttttgtatcattccactcactggcatttaaaactatgagtttctttcaaggtctatattagttgtattcaacaaattttggtatgtctccaactatgattgttgatttgcctattgttctttttggttaatgtatttgggtgctttatatttagtatattgattatctatatacttaattatattgcctttttatcattataaaatactcctattcatctatgctaatattcttcatcttaaagattcctttgtctgatattactatggccacatcagctttcttttgcttagtgtttgcatagtacagctatttccatttatttacttttaaattgtgttgtttacatttattgtattgttttattgttggttttaaattttttattttagtttaaggggtacatgtgcaggtaggttctatagatagtgtgtcctgggggtttggggtacagattgttacccaggtaacaagcatattacccaataggtaggttttctttttttaaaaaatttatttaattcaataggtttttggggaacaggtggtatttggttacatggataagttctttagtggtgaattctgaaattttggtaaacccatcacctgagtggtgtacactgtacccagtgtgtagtcttttatccctcaccctcctcccaccctttactccaaatccccaaagtccattgtatcattcttatgcctttgcatcctcacagcctaactcccacttatgagtgagaatgtactttttggttttccattcctggttacttcacttagaataacggtctccaattccatccaggttgctatgaatgccattattttgttcttttttatggctgagtagtattccattatatatacaccacattttctttattcaataattgatgggcatttggactggttccatatttttgcaatcatgaattgtgctactataaacatgcatgtgcatgtatcttttttgtataatgacttcttttccttgggtggatacccaatagtgggactgctggatcaaatggtagatctacttttagttcttgaaggaattttcacactgttttccatagtggttgtactagtttacattcccatcagcagtgtaagagtgttccctcttcaccacatccatgccaacatctattatttgagatggtttgcttttttcttgttgatttgtgtgagttccttgtagtttctggatattagtcctttgtcaaatacatagtttgtgaatattttctcccactctgtgggttgtctgtttactctgctgattattttgctgtgcagaagctttttagtttaattaaattccatctatttatctttgtttttgttgcatttgattttgggttctttgtcatgaagtctttgcctaagccaatgtctagaagggtttcttcgatgttatcttctagaattgttaaggttttaggtcttagatttaagtctttgatccatcttgagttgatttttgtataaggcaagagatgaggatccagtttcattcttctacatgtggctttccaattatcccagcaccatttgttgaatagggtatcctttccctactttagtttttgtttgctttgtcgaagatcagttggctttatttctgggttctctattttgttactttgatatgtgtgtctatttttatacaagtaccatactgttttggtgactatagccttatagtacagtttgaagtcaggtaatgtgatgcctccagatttgttctttttgcttagtcttgctttggctatatgggctcttttttggttccacatgcattttaggattgttctctcttgttctgtgaagaatgatgctggtatttcaatgggaattacattgaatttgtagattgcttttggcagtatggtcattttcacaatagtgattctacccatccatgagcatgggatgtgtttccatttgtttgtatcatctatgatttctttcagcagtattgtgtagttttgtagaagtcttttatcttcttaggtacatttgtgagtatatttttgcagctattgtaaaaggggttgaattattgatttgattctcagcttggtcgctgttggtatatagcagtgctgagaggtgacaacgtgctagcagccctcgctcactctcagcacctctttggccttgatgtctgctctggccatgcttgaggagcccttcaggctgccgctgcactgtggtagcccctctctgggctggctgaggctgaagccagctccctctgcttgtgcggaggtgtggagggagagacgcaggtgggaaccagggctacgtgtggtggtcgcaggccagcacgagttctgggtgggtgcgggcttggcgggccccgcactcagagcggctggccagtgccaccagccccgggcagtgaggggcttagcatccaggccagcagctgtggagaggggcaccaggtcccccagcactgctggcctgcccgcgccatgctcgaattctcgccgggcctcagcgcctccctgcggggcaaggctcgggacctgcatcctgccatgcccaagtccccccgtggtgggcttccgcgcagcccgagcctccctgatgggtgccgccccctgctccgtggcgcccgatcccattgaccgcccaagggctgaggagtgcaggcgcatggtgtaggactggcgggcagctccacccacggccctggcacaggatccactaggcgaagccagatgggctcctgagtcaggtggagacttggagaacttttatgtctagctggaggattgtatatgcaccaatcagcactctgtgtctagctcagggttcatggatgcaccaatcagcactctgtatctagctaatctggtagggacttggagaacttttatgtctagctaaaggattgcaaatacaccaatcagcactctgtgtttagctcaggtattgtaaacgcaccaagcagcaccctatcaaaacggaccaatcagctctctgtaaaatggaccaatcagctctctgtaaaatgggccaatcagcagaatgtgggtggggccagataagggaataaaagcaggctgcccaagccagctgtggcaacccgaatggatccttttccacagtgtagaagctttgttcttttgctctttgtgataagtgtggctgctgcttactttttggctccacactgcgtttatgagctgtaacacttaccctgaaggtctacagcttcactcctgaggccagtgagaccacgaacccagtgagaggaatgagcgactccagatgcgccaccttaagagctgtaacactcaccacgaaggtctgcagcttcactcctgaagccagagagaccacgaacccaccagaaggaagaaactccaaacacatccgaacatcagaaggaacaaactctggacacaccacctttaagaactgtaacgctcaccacgagggtctgtggtttcattcttgaagtcagtcagaaaaagaacccaccagttccggaaacagtgctattgttttgtgtacattaattttgtattctgaaagtttactgaattaatttgtcagtattaggagctttatggagaagtatttagggttttctagatatatgatcatgttatcagcaaacagtgatagtatgacttcctctttactgatttggatgccctttctttctttttgttgtctgcttgctctggctaggacttccagtactatgttgaacaggactggtgtgactgggcatccttgtcttgttccagttctcagagggaatgctttcagcttttctctattcagtgtaatgttggccatgcgtttgtcatagatggcttttattacattaagatatgccccttctatgcctgtgttgctgaggttttaatcataaaggatgctgaagtttgggggctatagagcccccaagagagtatgtcctttgtcttcagctaccaggattggtagagaaagaccctcagttggggcagggttaggcatgtctgagctcaggctctccttgggcggagcttgctgtgtgtggctgctgtaggggatgggggtgtagttctcaggctgatggagttatgttcccagggatattatggctgactttactgcattatacaggccaccaggggagtggggaaaagccagcagtgaccggcctcgcccaactcccacacagcctgaaaggccagtctcactcccaccatgtctcccatgcagccagtgagtaggactaagaacttgccgcaggttacaagcctccctgctgaaaaagcaagtagggctttcaggtttcatacctcccacctgtcatggtttctgtgttcatatctgcactccctatttgccccctttcccaggttctgtccaggaaactgtattcggtttaaatttttacaaagttcagctggaacttttcttcttcctatggtctttctccagttacactggcagccctccccaaggatctctgcaagacaaagtcaggaatggtttccctggggactgcaagtgcccacagggctcgtcctgctgcttcctctacccctatattttgcttggctgtaaatttgcctcagctgcatgtgaggtcaaatccttctcccatgatctggaccttcaggttttccacagaggatgtgtgttcgggggtggacactccccatatcacactttgggcactcagttttttggctatctcacaaagcctacagcagcaagcctcttccttcaaagcgtctgtggattctctcggctttcctggtatgttcctgtggtagttcttggagcaaaagttcatgatgtgagtctccacatgccgctctgtccatctgaatgggagctgcaagttagtccttgcctcctattcactattttgggaactgatctgagtctttacatttaaagtgcctttcttgtaaacaacatacaggatgttgcttttttacacaatctaacaacttctgcattttaattacggcatttggttcatttacacttaatataattatcaatatgtttggatttaagtctactgtcttgacatgtgacttccatttgtgtctcagctccttgttcctctgtttctacttctttgccatttttgtgggtgaataaaataatttttagtattccattttatctcctctaatgacattttaagtatgtctatttatttttttaggttgcattagaaattaaaatatgcatttttttacatgatacatcttcaacttatcaagtcaatatccaaatatatccttcataaatgatttaaaactttatatatgtttaatttttaccatcctactcttagtgttcttcgtgtcatatgttttacttctacttgtttaaatatccaataatttaaaaatatttaactaatagtttttaagggagaagttacacatctaaaattaaaatataggttataaagtcattagaacccaaaatttagagggagaatttagagatcattttatttcatagatgaggacactgaggtccagagatattcacacattttcctaatatcacattgttaatcagaggaatggtcaggaagtgattaaagtaaagcaaaatatcatatactctaaaggtaaagatttctggtattaggttcttgggtccccaaagggttcatagaaggctttaggatgtgtcagtgctctgcaattgaggattcatatctttcatcaaaattccaaaaaagtctcctaaagttcaataactattttatgaagacaatgctgacaatatttttagaataaaaattcctttttttggtaagtagaaaaactccaagtcatggagaccctgaaaaaggagtgtatgtatgtgtatatttatctatctatagatatagatttatacacatacatccatatgcattcatatgtatatatccatatatatccacatacattcatatccatatacacatccgtatgtacatatatgtatatacatatgtgtatatgcatgtacatatacatatatatggatgtgtatatatatgtgtatgcacgtggatgcatgtagatagatatttatgtatatatccatatatatacacacacacacataatgcctataagcacataaacacaacaaatctgattgatcaattacttcatatcaagtatggcagacagctctggctagtttcctacctgtgaatcagagaaaactgattattcctttccttaggaacttaaggtactgacaatctgattgccaaaacaagctgtctaaagtgagacatagacaatgttcaaagcaacagtgtcctgaaggatcatagtccattctctgcattctctgtgtctgtatatgccagagagctggtttctttttttttttgagatggagtctcgctctgtcgcccaggctggtgcagtggcgcgatctcggctcactgcaagctccgcctcccgggttcatgccattctcctgcctcagcctcctgagtagctgggactacaggcgcccgccaacacgcccggctaattttttgtattttttagtagagacggtgtttcaccatgttagccagggagagctggtttctttaagagtctagctcctcgagcatccacagactcaatataaagtagaggaaggaagttccttcttaaaaaatgtatttcctcatttcaagtttagtaatgttttcttgtatgtatgtacagtggagcatagcagctcccagtgagataacaaagggcaggtacttttgccttccaagtaagtcttgccttttaaacctatcaggaaaaaaagaagttttatatatagagattgggattccagagtcatcttataaggagaaagtattttctaacatataatcaaaattccttccctttagtttagatcagctttgtccaatacaaatataatgcaagtcacatatgtaattataaatattctagttggctcattaaaaaaagtaaaaacaagtaaacgtaactttaatagtatattttaatattttgataacatatcaaaatgtcacttcaacatgcaatctgaataaaaattataaagttattttatattctttttttcacattaattcttggacgttctgtttgtattttacatttatagcatagcttaatttgcaaactaagttttcatagaaaatatttgatctgtatttagatttcataaaatttacaggcaaaatagttgatttacatacttgttctaaaatactcaaaaatattttaatatattatacgtgattcataatatatgaatcaaatattagttttaaaatttaccacaagttaattaaaactaaataacattaaacttttggttcctcggtcatactaaccacatttcaagggctccgtagtcacatgtagctagttgctgctgcactgagcagtacggctctagtctgtagtagagatgagataaactgattgctgtcactcatcatattccgaacttgagaattgtaattgaattgcccctcaaactactcttccctctcctatgtacatccattccctttagtttatacaagagtaaacctatttgaggtactgtgaaattctcaaaacaaaactttatttatatttttctaaagagagaaaagtgaatgctttaaaatgatttatagaaatcactaaaaaaaaaatcaaactatcactccaaaatgctgaggataactgagatagttctttttttgagtactaaacaactgttacaacttcagaaacaaccaagcagatttttcaagcaaaaataattgcaaaatttccttccattgaggggaaaaaaacctctaaacacaatttaaagttttttacttgaatttcctagtctgaaaaggagcactttgatcaaactatagaaactgatacacattgaaataacatacagttgtgagtagtataaagtgaaggacccagcaggctaggataataaatggcaggtaaatcagatgactaaccaagagtaggaggaaggcgtggttcaatggggagaaaaaattcaacagaccatgccttcgggattgattttccctgtttatcttgttatgcctggctgttcattttggggtggtggggtcatggaattgatttttttaaatcaatctttttatttcttgagaaaactatgatgaaatgagatcagcttcacccagatgcagatttattagtgttatacccacatttaatagatggttcaatgagaggttaaattatttgcctgaagtcaaacatttaataattggctgagctggggttccatgcagttctatctgtttctgaagaatcccctacattgcaaattcattaattcccagtggggcctagtctcattcagaaatgagaatagtcatgtgggcatgcaggccatgccttcttggcatcacgtgaactgggttagatgtgaggtggttgctttaagaacaaggaatctgagtgagggttgttggatagactagaagggtgcccacacaggccagtgtcagagcagtgatgaactctgctcataacagagttattctgtgtgcctaggtactggagtcctcatggctaccacatttaagagctgtcattcctgtcaattctggataaatgcttggaaattcttgctctttgggtgtgtctttttttcaaatccctcaatgcaataggctttcctttttaaaggaacatgtacctgaatcctaacttgctgtctccatcatgatttattgcattggctggtcccaaagcccttctgcttcacatccgtaggctaacttcacatctataggctaatttattgcattgattggtcccaaagcccttctgcttcacctctacatatggcaaatttatacttcaggcattggtttttacgggtttcatttctggatgattaccttatttccaggtcctgtaagaaccttgcctcatgtctttcttatgctaatgcaagagttgtaggagcacatagaataaaccaaagatgtaatctctgaactaatgaagtaatgagaatccaggttgtgcctttgttgtagagtattaccaaaatcacaagcattttttaaaaagctgcaacctatctaaacacccttgatattgcaatatcacattaataagaaaagcccccagagagcacagtgctcatgcctgtgatcccagcactttgggaagccgaggcagtcagatcacttgaggtcagaagttcaagaccagcctggccaacatgtgaaaccctgactcaactaaaaatacaaaaaattagccaggcttagtggtgtgtgcatataatcccagctacttgggagggtgaaacaggagagtatcttgaagctggaaggcagaggttgcagcgaactgtgatcatgccactgcactccagcttgggcaacagagtgagactccatctcaaagaaacaaggaaagcccccagaaaatttactttaggtctactacttttaaaaatgtaaaataaaaacccaacttaatatgaaacaaaaaaagacaataatcgttagaaagtattttctttattttaatgtacacaaatgcgtacagatactcacaaacatatattctcatgactacttgcatggaccagcccttccaccactccagaaacacacactaattggtgttatgttttagcagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccaggtacagtatttcattcctgcttaccctactccactataccttcagttaaataaatgtttaggttgggatatttttttttcttaagaattaagttttaagaggagtaaggtttcagtaatttcaattggtttgcttgcagtgagtttaatcttaacccaaatttacagcctgaaaaagtcagaaaaagatgatttttttcaggatatgttaaagaaaagaaaaattttgtttcagttctaattattagtaattgctattgattttctatgatttctatattggtcaataatccccatttttttctcctatttcttttttttgtttcatcctgtagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaaggtatggtgttggttctagtaactttcatttcccaaacagactgtaccatctgtgtcagccttgcccacactgacctgtatcatcttgacttagccaagcccatcttctttgtcattcccatagcatttggtcattaagattattccccagaagacttgtttgcagccagtctctgactgcttggtgctaactgctgtgctggatacactttaactggtctgtgtggcacaacacagaacttgccaaaattagcacttccaaaattgcaaattttgattttacatgtgaactaaagtttggagattttagataataaggaatgaaagattttataattctctccctgagaaaataatgttttctgtttatattttagttcttggctagtgaacaacactctttacctgtatttactgtggaaggactggaaccttatgccttatttaatctttctgtcactccttatacctactggggaaagggccccaaaacatctctgtcacttcgagcacctgaaacaggtacaggggttaaaatctgtcttttttcttaaaaaagcagaatctcacttttcatgatctggaatggatagttgatatttaaaaataactttcagttttatagatgtgtttagattcaataccctttcaatgactttttggagattagaatagcgtcattaacataaatatgcataatttattccaaaagaatatttcaaagatttcttaacagccatttcatttgattgtagtgatgtagaagatgcagatgcatatttcaggtaatttgcaaaatcctttataaggaaaatgggcatttaagggcagagacagttttcttggaaggcagactgttctcatagatgggaactcagaatcttctgtaggtgaataactgatatctaaatttaatgttttggggaaaagatattttaaaaaagatactagccatatcattacatgtgtgtatcaccttaaagtgtacaaaacacatttttatgtatcactcctttattaactatttactacatacctatcatgtgtcagaaacatcatttcatttgatcctcacagagctctgaggtgggtaggaaagtcttattatcttgattatgcaagaaagaaaatgaaagcctagtagttgcccaaataaaatagttactaagtggctgggctgggacttaatctggacttttcactacagtttcatcaaatctccattcagtcacttttacaaatgttggtaaatgatagtaatttatgtaaagctaatacaggatttggcaggtggtaagagcttaataaatatagatatccattctccattgcattttttactattaagattatttcaacaatatccatctacgaattacacaacaggaacatagtggggcctgggcaggttccggagcagttagcattggatccaggaatgttctgcttgagatttccttgggatatcagcttggttgaattgtcctgtggaaatggacttgactgcatccatcaggggatccagtgggagcaagagtcaacagcactctgctggatattggagaataagaaaggatgacaagatttggcctttgccttcaggaaatttacaatatagccaggaaattatccaaattgaccaatatttattaaccacttactgtatgccagttctgtactagatatgggaagatttaacaaggaataagaagagatgctttctctgatggagttcataaaacaggagggagataaacacatgcacagcaaatgataatagatactagagagttatacctgagcagcagtggcatagagtgagtagacaagcctatgaaaccttcacctatatcaagctgcctcaggcatttttaagagagaaggtgcctttgggaaatggaaactttagtgcactctgaaagatggagcaagaagaggtatcccatgtgagaagagaagcctaatgtaagaaggcctggagattgaataatagtatgagtgttaaacattaaatagcaatgtgattggaatgagggagggaatgaagaccttgtggaggagtcctaagagaggagagggccatccagagagaatgacttagaaatcaggcagagacatttctcttgattaaaggactgagagatactgaattgcttggtttggctctagaataaatgaatactcccaaaccttactcttggggtacgatcagcctcccctaaactttctgctttctaggaacttcagagtgacagggcctaggtctctgatttatgctgtgttttacaacctgaactggctgaaggctggtgggacttactgccatccatcctgatgatgacattttcaccttcactgaaatcactctgtcaggataaaagtgaatgttgcattttacggggagaaccagacagcttccatctacacaaggcacagacaagaaaggtgtgcttaagtggtagtaggaaggatttgagttgaacataaggaagtcttgcctgtcagtcagatgtgctgaaattatcaggatgggttcctgaagaaatctatggaatattctctcctgaagatctttaagaatgtaataaatatactgcaactgcctggaatgagaaatattgttaagttgtttacaatcttattataagtggtaaaagtcttatattctttatattcttatattcttttctgctctacctgtgcctctacttttcagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggtatgagagagaaaacagaagatatgagagtcttaatagcggcattgtggggagagggaaagactatgtttctgggatatgttacagtgtaaatggcacacatacctagattttgattggccactatagttttttaaaattatgtgagaaaattaatggaggtaattcagataagagtgactaaagtaaactgttaaagaaatggaaagtggaccttttgaggattaatatgcaggaattcgtttttattccattaaagacgactgcagttaaaaaaaaaagtttaaacagaagaataattaaaggactaggttaagaattctgccaccctgtcaataatttaggtatactgtgatcaaagaggtcaagtgggcagcaaaagtagagaggcaagaggggattgcttgggtgaaggacactttcacaactttctcacattcagggaactttgcaaattcagagtaagtcattctttttctttttgcttttcttttgaagctgtatcatgattttaatttctgtatgttacacattactgatttgttttacattttttattgatatatattatagttgtacatacatttggggtacatgtgttattttgataaaccattatttttcaataaaatcactataggccttgcaccactgtaggtatttttgtattcattatctcatttgatcctcatactataaagaaaaagttaagtcgttgagagtatcagtcaattaccaaagctgcgtggctggaaagcactgtgctgtaatgctttccaccatttctttttggggaaaataacatcttggggagtgttttggagatttgagttgtgtagggatttgtttttcttttcataaaattctaatttaataattattttgataatttgttgtctacatatactaatcaaataagttatacatgaaagttaaagatagtacacgttcctatttggtaaaaattaggagtgttttggtaaaataatattcgggttaagtgtgtctatatatagaatatatagtatttatatagaatatataatataaatatgtatatagatatatagtttcaaattttggtcaccatggaaccatgcaaagtgatatgcatggatatgtatgagtttcatttaacacagttttgtacaaaagtaaacactactatatatatatatatgcaccattataaatcatacagatagtaatatataaaatacagtaaaatatgtttaatactaaaagtataataaaaataatacaatgttttgttgataaagtacttggggctttatattttgagtccaccattatagatgtcaattttctttgcaggctactgtacatatgcaaggtttggaaatggaaataatttattacataatagaaaatatctaagaaaaaaaataaactttactgttagaatgtggcatggcccaatgggaaaaaatgtatgtagacctcagaagacttggttctgatgccagtttctacatacgtcattgtgcatgagttacttacctttattagtatcctggtccagtttctactcttagtagttgtgaagatcaaaagagacaatgtatgtgaaactggtttgaaatgcacaatcattttcaaatgtaagatttaattatttttaaaagttactctttctaaaaagtctggaaatttagttttttgaagcttctagttgttgaattcaagaaaaatggaagtttatcataatttgtacagttttatttctgttaaatgttctatgtaacttaattttgaaaataatgaccttactttatttaaaaatattcaattgatatatatatattcaagctgtacaacatgacttaataaatgtatacattgtgtaattatcacaattgaattaattagacattcatcaccatccatgctgtacattaaatccccagacatttttagaaattcattttttagcaagagagatttgttccaattcttgcacttttctagattaaaaaatctgtcaacataaatatagagcaatattttttctcttggtgatttatattgctgtatattaatgtcaataactatttgaaactattaatattgtgtatcaggagtatgaaatgaaacatttagtaatctctcagtctcagaacttaattgttgccacggagaacactactgaatgcaatttttgtttccttttctttaggttagggcctttacatctaaggggccaggaccatatgctgacgttgtaaagtctacaacatcaggtatttgttttctaaaatctgtgcaaataataatttagaggcgtgtgtgtgtgtgtgtgtgtgtgtgtcccattggtgtctttagggatatgaacactgtctctttgctaaagtttaggtcaaaaacatgtttttgaccccaacacaccaccaaaatatgtttaaataaacctaggggtagagagcctacaaggttatcactgagaaagatctattagaggaaccaaagggagcccatggacttcaaaactgccagatattaaatcgagactttgctaagctaaagtcagttttctcatgcatattatctacatgtttttttgctttcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgaggtatttcactatgtaattcttccgaaataaaggaagtgaagtatttgcatatgacactactttgtagttaaaatgactggaaaacggtttagtcattaagattagaatgaaaaggacagatattgtataattatttagccacaaatgaatacagactacattttgggcaaatgtcattcaacactcagttagcaaatagttattgggtttaggatgctgtgttagagcctgggatattatgggtgaaagtttataggctttgctcttaataaacccagtctagtattagtccaacactaggaaggcagtattgcctagtgattaagaaggtgagttttggaatttgactacctagaatgcaatttgggctctactacttactagatttgtgaccactggcaagttatttaacctctgtggttaagtaatacctcatcatagggttcccatgaagattaaatgagataatccatgtaatgcacttagcacaatgcctggcatgtggtaggcattcactaaatgttaactgatagtgaagacagactaggataactgttgtgctgagagcaggatgtggtggaatcacagagaatgaacacgtagtctaggttggcttggtggtggtagaatggaaaaacatcttggaaacaaagatgagacaggtgaaggctgagggggtacaaagacaggaaaacaaagagccatagagtgtttggatgagagtggagtgaaaggaaggtgggaaatctggagaggtgggagcctgagcataatgggcctcctttactgtgctaaggagacaggtgtcattctagaagccaacagcaagccagtaaagatatttagtgggtcattaacatggtcaagttgtgttttagaaaggcctgtctgttagcagtgtgaatagtgacttagagagggttaagtctgagacaattaggaggctgtcacagaaatccaggtagaaaatgttatgggcctgagtgaggggatgagcatgaggtgagaaaggagatgacaaactggacatttaaaatgggactagttcaagctgcacacagtgattcacacctgtaatcccaacactgtaggaggccaaggcaggtggatcactggatgccgggaattcgataccagcctggccaacatggtgaaaccctgtctctactaaaaatataaaaattagctggacgtggtggtgcgcacctgtagtctcagccacttgggaggctgaggcaggagaatcgtttgaacccaggaggcgaaggtttcagtgaaccaagatcatgccactgcactccagcctgggttaccgccagactccatctccaaaaaaaaaagggactagtttactatgggtagtaatgagaagaagtcaaggaggaccatatttgtcaggattagctccttgggtggtgttggaaatccataaaaatataaaatgcaggagaaaaagaggttttggggtgggtgatgaagtctgttttctgggataattcatatggaaatgttcagtaggcagtttgatatttgaatcagtgactcattaaagatcttgtctgaagatataaatttgtagcactggtttgtagattgcagttaaagccatgatagttaaaatcatttaggaaaaatgtgagaacagtgcccatgttacaatggtataccgtccagattgctgaggtttgggattacaaatgagaagtgcagtaaacaaatgatatgggtgaatatagaaaagtcttcaaataaaaaaataaccactctcttcttggctgtgttctctacctgttgttaagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaaggtatgtaaatgcaagtatttttttatattgtgatgaaatagatatagacatatttaatgtaatgtctttggtttaatagtagaagacaattatggaaaaataagatgcttagggctcttggcccactatattatagtaagtagttcttcatataaattaggaggcacaactacaaatatgtaaacttaatgcatactgacaatttgactaacaaagttaggctaattacctaaaaggaaacaatagcagatttttatactagtgaatgcaataacatcatcagttggcaagtacaagaagtggattgagacagtggcaagaggtgagcaggaacagatgggcagcatgccttgcacagtaaaagttattctgtgctcatccatcttagtttaactaatatcctcataaggtgagctttaaagtttccttttagcacctaagtagcaatttcgcaggctggaaagatggatttctgtttgggccataagcatggggataggctatttggaaactagatcattaactagtattaagaagcagaaacaaacatgagaggaggggaatagagatggacattgatgaaaattagcaaatatattttatatttcagttattaagtgggccttttaatatagcacctaaggtcattatattccaagactttagttgtaaacacatctattgagaaatcattggaaatgctacaagttagacttcttgtgacttcttccatctcagaaaaaggttattgaaaacttgaccatgttctctccaaaggctccatttgtccctcacagtcattagcaatagttgctctgcattagaaaccaatatttgaaatgatgtattttactcattaagttggggggacttttttttcctctatagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcggtaagatgctgatgtatgtgcacagatatttgttaataagagcagccccttcaactgcatttacaaagggcttgcattccgcgtatactcaaatatacacatgatatttgctctgtaccatgccaagtgttcttgcagaattcaaatcaagttgtttccaggaaaattgtatgtaggcattcacataattttctaaatctgtgttttaaaaaattgtaattaacaatagagctacaatttaatgagcttaactgtatattcttagcatgtactaaatgcattattttatttaatcttcataatacctcagtgcagtaggtactaatatcctcattttacagatgaggaaactgaggctgagaaaagtaaggtaacttttcccaagggccacagttagttagaaggagttgaaactgggtctaactacaacatgcatgatcttcccactatcctaaattatttccactttgatgatcccatagattccactttcaacatgaattggtcaatacctgagtctatttgttgaaattcagatgcttgtagaataaatattcgaaagtcgagtacaatttggaagtctcctaattaggagtaattcaacagaaaaaaatatatactctaaataccccatatactcttaaaattacttttcattgcccagtgtggtaatcactagccacatgtggttatttaagtttaaattaattgaaattaaggccaggtgcagtggctcatgcctgtaatcccagcactttggaaggccgaggtgggtagatcacttgaggtcaggagttcaagaccagcctggccaacatggtgaagccctgtttctactaaaaatacaaaaattagctgggcacagtggtgcatgcctgtaatcccagctactcaggaggctgagacaggaagactcacttgaacccaggaggtggaggttgcagtgagccaaggtggtgccactgtactccagcctgggtgacagagtaagactgtctcaaaaaaaaaaaaactaaaattaaataaaattaaacattttaatctcgcagtcacactagctaaacttcaagtgctcaaaagccacaaatagctaatggccactgtattggacaatgtaggtataaaacgttttcatcatcactgaaatctattggtcactgctggattatacagtaaagttttgaaattgcaaatatgtgtgtatgtgttataattgtatataggttttgttgacatgtcaaccaaggccttttagaagcaattcctatgtttagaggccttttagaaacaaggccttttagaaacaattcctatcattaagtagatttaatgatagaggtaatgttttgaatgattcctccttagttatattacttgtttctgttaaacctgtgacaaagaccttttctttgatcaaaatgtggttatgctcctctgagtcctcttcttgactaggcctcagccttggtcttcatgtgtccatccttgctgagttcagttttagcaagaatcctacaaagtcagtttaggagaaccccctaccactgatacctgatcaagttcttcatctcccacccttgatggacattggtctgatttaagtaagaatcctgtttaggctcttggcctgcctttagcaagaatcccattaggctaatttaataaggattgctctatcctggatgctgtccctgtatttttccacccaatgacttcctcactcagtttcttggctataaaaaccccaactgtctttgctatgttgcaatatttgtctttcctagtgcgctattgcacttatcttgactaaagtctttcttaccattttaacaagtgtcagaataatttttttctttaatatttgatacacaagacacaagaattacctagtagaccattatatatgtataaaactggtcagtttttcataaacctgtaattaaaatcctaaaattagaaaattagaaagattttagggatcatttagatgttatgatgttgcaagaaattttttctttaaaaatagtcatgcttaaacaactgtttctttaaaaaaccctgctacttcataaggaagtctgtttaagcttttggacaattatgaatattagtttttttcttatatttagcctgtcttctcttcatttctcccgttcattagtcttagttcttacctctaaatttacaaagaataatttaatcactttccacatgatagccattcaactatgtagagataactgttgtagctcattgtaagcactttttttttttttgagacagggtctcactctgttgcccaggctggagtgcagtggtgcaatcatggttcactgcagcctccatctcccaggctcaggtgatcatcttgcctcagtctcccaagtagctgggactacaggtgcacactaccatgcctcactaattttagtattttttttgtagagacagggtattgctatgctgcccagtctagtcttgaattcctgggctcaagcaatctgcctgccttgacctcccaaagtgctgggattacaggcgtgagccaccatgctggaatcaagcattttctttggaggaaaaattcaagtatcttcaattgctccccaggcaatgtggcatctaaatctttgtcctagtcgccctcccgtgatttcattccagctagttaatattctcttaaatattgcccccataaagacactgcactctcaatgtgttcttgtcagtgaagggagactctaactatgaaggtcttctttttgttgtagccaaaagtggaatcagatctttaggatgcctgccattgaaagaccatagtcttttccacattcattattattaagccagatccctttcattcgttcatttacagaattgatatgaaacttaaatttaggattttacatttgttcgtatcaaatttgaatcaatttcctgattctgttatgatatttttgaatttcaaggctgtaactgaacctgctagtgatggtgataatcatttattatctgcaaagttgataaatatgtttactatgcattcattccaaaccactgataaaaatattgagaaatgcactgagccctatgcctatcatttaatatttccctcaggttggcattatttgattttgagtcacataggtgggttttaaatcctgggtctgccctttggtggccttgagcagattatttaactcctttaaacttcagtttgcctttccacaaaatgaggttagtaataatagtagttacctgattggcttgatatggtgctaaaatgagagaacatctctaaaacccttagtcaaatgacataaaataaaggtattttttaatgttgaaataatagattcaaaatttagcaattataatatagaaaaaatttcatacatttttagagtaaaaaatgtaagatattaattttgttctttatattccttatgtttttaacagcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccaggtaataaagtcacattcgtaatcagcttgttctcccaatttagggtcagaaaaatctcataacatctccttctccaaggctgtccctttagcccctttgttgtgctctcatccttgctccaaactctgctagtcttctgtgtgcactgtgattgctgtttgccctggatcacaaattacttctatgtgtaaacacagctcagggtgtggtgggcaactttagacatgggaaacctgcgtcctgttgttctctctgcctggcctctttctcttctcagtcccataatttctcttctttctcttatttctcctttgctgatattttaggcctcccagtggtgtcaaaaagcattgcatacaaccttgttttcaaggtaacaggtcatacttctgttactatgcagtatgcagtattaggtatcaaatcactaagtattaatatatactattataatatgtagtaccatttaacatgagtaagcctgtgctaccatttttattaagtttttatcttttttaaaaaaaatgtcactgatgaagtttttagtgttatgcccctcatcctacttttcccataaactgtgaattttattgtgtgatttgtacagtgcaatgattcctagaaaggcatgtatcatgttatagcagaactgactatatattttctactgacagtcataataaaacattgttgaaatctaaaaaccatacaaacaaaaacaaaaacagtattgccaaaaaaattagcccagcgtagtggcaggtgcctgtagtcccagctactcgggaggctgaggcaggagaatggattgaacctgggaggcggagcttgcagtgagcccagattgcgccactgctctccagcctgggcgactgagcgagactcgtctgaaaacaaaaacaaaaacagaattgcatggcctcattggtattttgtcaaagccgtctttgccactaaggtgcaaatatcattctaaattaactataactctcctctggagagggacagatatgaatgacataaactctctttgtttaaatgttttcagttataaaatatgtaaattgaaaaatgttaaaatttataaataaagcctactttgtatttttgtaaaataatttatttttcactttgagaaatttaagagattttaaaagttcatgtggcttctggtttctggcccagaagcttagaaattgccactccacccaaaaacaagtaaaagtctgagcaaactgaaaacttaacagctcttcttggatccacaagagaagtgaggtcacagagcaaactgctgtccccagttggaaagacagattggtaaatacagagaattacaatttaccagagcaaaaacccatgagctgaaatctttttagaaagcagtgttagtggtagaaaaatccaaactgtaattgatgaattgcttgaggctcagtgtgggtaactctgagagttagaaactcgaggggcatcctgtcataggagggcttcattttataagttttacctccaggagctttaactggtttttttcttagagaatctccttgtgcttcccacagagagaagggaaaaggaaaaattttgaaaggcaccagagcattctgttcttcttaacaagggctgcattcaagatacactaatcacagctggacctgctcgggttttatcagagcttaattgacctgggtaaagagaagtgcccaaccccagcccactccagccgtcgtgtcccacctaagtggggtggggggactgaaaagaacctgtgaagttcacagtcgaaaagcaaagcaaaaacccacttgaagttaactgagatctaatctaagactataaaatgcctccccttcccctacaccttaccaccgcattactaaaggcccatttacagcagttgctttcacccagtacagcatattcagctatcaagaaaaaattacaaggcatactaaaaggcataaaacacagattgaagagatagaggaactatcacaatcatttaaatatggcagggatgttagaattatcagactgagaatttaaaacaactatgattaatatgctaggggctctaatggataaagtagtcagtatacaagaacagatggtcaatgtgagcaaagatatggatatttgaggaaaaaaaagaaatgttagagataaaaacactgtaacatgtgaggaatgtttgatgggcttaatagtagactggatgtggctgaggaaggaatctctgagcttgaaaatatctcagtagaaacctgcaaaactataaaggtaaaaaaaaaaaaaaaaaggaaaaaaaccgaaacagaatattcaagaactgtggggaaactacacaaggtgtaagataggtataatatgaatactagaaaaagaagagagaaaggaacagaagaaatatttggaggaaatatttgaaaaataatgactgataatttccccaaattaatgtcagataccaaactacaggtatgggaagctcaaagaataccaagaaggataaatgccaaaatctacactaggcctatcatattcaaactgcagaaaaccaaagataaagaaaaaaaattctgaaagaagccagaggaaaaaatacttaacctatagaggaacaaagataagaattatatccaacttctcctcagaaactatataagcaagaagagagaaaagtaaaatatttaaaatgttgagagaaaaaaacactaacctagaattccataccctgtgaaattatccttcaaaagagaaggagcaataaagacattctcagacaaaaattgagagaatttgttatcagtagacctgctttggaagaaatgttaaaagaagttctttagaaagaagaaaaatgatatagatcagaaatgcagatctacataaagaaaggaagagcattagagaataaataagtgaaagtaaagtaaaagtttttctttttcttaactgacctaatggataatagtttgttcaaaatagtaatagcaataacatattcaattatatccacttatgtatgtatgtgtgcatatatatatgtgtatatttatatttatattaagcaaaatgaatcacagcagtgacacaagggatagaaaagaggacttgggagtattttgttattataaggtactgcaaacctgtgaagtggtatagtgttgtttgaaggtggacttggattagttgtaaatatacattgcaaattcaagggcaaatcactgaaaaatatttttagaaaagtataactgattcccaagaaaggagagtaaatagaatcatttagaatgctcaaataaaaccacaaaagtcagaaaaaaagtggaagacaaaagtaggaacaaagaacaagggcaacaaatgaaaaataataacaaatatggtagatcttaatttaactatattagtagtcactttgaacatcagtggtctaaatacaccaactaaaagacagaagttgtttgagtggatcaacaaacagactcaactatacattgtctataagaaacccactttaaatataaagacacatcatatagatcaaaagtaaagggatggagatagtatatcatgctatcgctaatcaaatgaaagaagaaacaatttcagacagcagacttcagagcaaggaaagttataagggataaagagggacattacataatgataaagggatcagttctccaagaagatgtaataatccttaatgcatatatctctaacaacagagcatcaaaatacatgaggcaacaactgatagaactgcaagaaacagatgaagccactatcaccattgaagacttcacgacatctatcagaaatgggcaaatccagcagaaaaaaaatcactaaggatatactgatgaactcaataacaccatcaattaattggctgtaatggacatctatctactattaataatttttccaacaacagcagaataaacattcttctcaagctcacatggaacattcaccaagacagaacataaaatacacttcaacaaatttaaaagaatagaaatcatacaatatctgtcctcagactacaatgccatttaactagaactcaataactgaaagatagctggaaaatctcagaacacttggagattaaacaacgtatttctaaataacaaatgggtaaaagaagaaatctcaaattaaaaatattttgaactaaaaatgaaaacaaaacatcaaaacttacgggaatcagtaaaatcagtgcttagagggaagtttacagcactgactgcatgtattaaaaaaatagatctaaaattatttaagcttttactttaggaaactagaaaaagaagagtaaattaagtcccaaataataataagaaacaaaactaaaacaaaagaaaaaataaaaaggaagtatagtagaaatcaatgaaattgaaacaggaaatcaatagagaaaaatcaatgaagccaaaaactggttctttgaaaagataaataaaattgataagcctctagccaggctaagaaaaaaagagagtggatgcaaattgctaatagtagaaatgaaggcggggacatctctgtagaacccatggagattaaaaggataatcaaggaatactattaacaactctatgctcacaaatttaataacctagatgaaatggaccaattcttttaaagacacaatatgccaaaactcacagaagaagaaatagacaatctgaatatgtccacatctattaaataagtggaatcaataattaatagccttctgaaatagaaagcacctgggccagatggattcaatgatgcattctatcaaacatttatgggaaaattataccatctctacaatgtctttcagaaaattgaaccagagggcctacttccaattaggccaatgaatgagtttattctaggccagaattaccctaaaaccaaaactagacaaatatattacaagaaaagaaaattttagaccggtgtctctcttgaatattgcaagaattgcaaaagtcctgaacaaaatattagcaaatcaaatcgagcaatatattaaaatagttttatatcacagtcaagtgggatttatcccagctatgcaagtttgagtcaacatttgaaaatcaattaatgtagtccactatatcaacagactaaagaggaaaaatcaggcggtcacattgatagatgcagaaaatgcttttgacaaaattcaacacggattcaggatgaaaaatcctcagcaaactaagaataggggtaacttccttgagaaagaacatgtataaaaaaacttgttgttaacatcattacttaatagtgagaaattagaggctttctcactaaatcagaaacaaggtaaggatgttccctctcccaatttcttttcaacactgcagtggaagtcacagcatgcaacaatacaagaaaaggtatacaatacaagaaaaggtatactgattgggaatgaagaaataacgctgtctttgttcacagatgacatgatcatctatgtagaaaatctgaaagaattgacaaaaagactcctggaactcataagtgattatagcaagtttgcaggacacgaggttaatatactaaactcaatcactttcctgtataccagcaatggacaagtggaattagaaattaaacacacagtatcatttacattaacacccacagaaaatgaaatacttaggtataaatctaacagcatatgcacaaaaatctatatgagaaaaactataaaaccctgatgaaagaaatcaaagtgctaaataagtatagagatattccatgtcatagataggaagactcaatattgtcaagatgtcatttcttctcaacttatctatagattcaataaaatcccaatgaaaatcccagctaaagttattttgtagatattaacaaactgattctaaagtttatatggagaggcaaaagacctagaataggtagctatcacagtattgaaggagaagaacaaagttggggaaggctgatatcaactatatgacattctgggaaagtaaaaaactatgtagacagtaataagatcactagttgcgagaaggctgggggaagaagtggcgaatagacagagcagagaggactttgaaggcagtggaactattctatgtgatactataatggtggatacagctcattacacatttgtccaaacccgtaaaatgtacaatacaaaactgaactctaatgtaaactatagactttgggtaataatgatgtcattgtaggctcattgattgtaacaaatgtactactttggtaggggtattgataatgggggaaagttatgcatgtgtggagaaaaggagtatctgggaaatcttggtacattcctctcaattttgctgtgaatctaaaactgactaaaaaataaagtcttaccaaaaaaaaaagacgtccatgcagtatctgaagttgaacgacacacacacatatcctcctcccagccacatacacaaacacgctccaaaatgaagtcccaagagtggcatgagttttttttttaaactggaactcattaagagtatgattaatactcattattttctttaaaaaatggagtctattttatgttgctagtttctaggtacattattaagaatactttacctccatctgctggaaattttaagcaattacaagttatcttggtcctttttttctgaaggtattcaattatcttcaaaatgtatgggataaaaaaaaaaatgtaagggaaaaacctgtctttctgtcctgaataatgtttctgacacttcaacatgtcatattatatcaattaaataaaagaacgacaaaattaccaatgacttttgaattagataattgctctgattgctcacatgtgtatcccattctctgttcagatcagaaatcagtacaaactgaatatattggataaatattggttgaactgaagagtggttcatcttgtaactttagtaaggttatccatctctaaacccccatactttccaaatgtcctcaaacttaggttcacagtgcccttgacactgttgttggagattttcgatgtacttctaattttaaacattttttcctgcattttggaattcatatttggaattcccagaccagaccagcattattttctctaacttttcattttagtctcagtaatgatgatagtaatagctaacatttatttaatgttcttaccatgtgctagggatagagtgatatataaatatctgtaaagcaggccattgtctctgtttacagaagagctggagtaaccttcccaagacaaaaaagttagcaagtgaaggagctggcttcatcaagtttttgtcacttagacatttaccccctaattttcttacttgctgaatgcaaaggttgtattttatatgtggctaatatgaattcataaggatcgacaacacatactaaatacctaatatatgtcaggcaccctcctggggctctggtggaacaaagataattcaagcacagtctcagccaaagatagttacattctagtgctagatgaagaaaagaaagcagcaaaagaaaaccaaaaccaaaatcacatgtggctagtgcactggtagaagaacacgtgaagtggagtgaggacagagaggagatgtccttcacctggaataggaaggcagaaagggcttcccaggaaaaatgatgcatgaattgaggcttaagtaaggttaggcagatggggaagatcattccaacctgaagagactacctatgtgaagggttggaggggtagaagtcctgcagtgtgtagatagtgtactgtggttagagtgaaggatggctttgcatagcagagactggatatgcgggcaggagccagattgcacagtgccacgcacaatgagttaaagagttggctaactggtgtaagattgttagatttcatattaaaatcatatttggagttatttgcatattatgtaattatgctacatttttaggtgatgttttacataaagactgagagtgaataggtcaagaagttgtgttcagctgcaagtgacagatctgcgatttttcgaggcttaagcctgcggtatggttgcgctactgcactggtctagaacagaccatttccattgtagtctctgtgactggggctccctggagttgtgcagcgtgcaaggtgtttggttgtaagcggtggccagggagctccacaatgccatcaatcacctggacttgatctttccccaaacatccttagtgagtcctttattcaattctcacaagatggctgccgcccctcttgcatagtgtccgcctcctgggttgggggagggtgaaggacagaggtgcgccacagtgataagcacatctgactaaccagaccgtgtcacatgattgtctgggctgcaatcaaacttcagaaacagtttttcctcccagcatactgccctgaacaatatcagatatatatgaacttgaagaaaaggagaggacattgggtagactgtagcagtacatactacacatactacacacagtatcaagctgcagccatttttgtttcttcaaagagaatattatttcaaatcattttcatatttatgttttcaagcaaaagttatgtatgctctacaaatttctttctaagctttgatattattcttgttaaaaatctgcttttcctctcatatatatagtatagatatttaatcttttggtttcttcttattttagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggtaagattggaactagtggtctttgtcttttcacaagatgttcttttttgatataaaattatgagccatagtaaagtatttcctatatgttctgaaatggactagtacgcaacttttttacagctaatgattcatcaaaacatattgtgttctagttttcttgactgggagtaagttaagcttcaaggaagtatatcaactcttgcccattgatggattgccatggtaaccgttttctgagtgtccagaaagaattgggtttattcccctccctgattatctaattatcctcagagagaatgatagagaattatttttgcagcctatggagcagactgaagattgaagagtaagaaatgaactggacggaaagaacattgccttatacctcttctccacagcatttatctaatataaaaattgtacattatattttgtcttttgtttcctatgtgcagagaaatatactgctatgcagatactgtttttagtcatcattgtatgcctagcacctagcacagttagtggcactgtgtaggcattcactaactatttcttgaatgaattggcactattcattcaatcattgaaatgatgaaatgtattcattagtatttcagttgtcttagtgatggaatcacatatatccaatattttgctttgtgcttggctttatttagcctgttcaaaaggtgaaattgactaactgttggatgttaaacactatatgttttcccataaagtgtatgtgatttttcattccttccttaattttgtctaattaaccctttttacacatttctaaaataagtaatttcagatagatcatttggctggccaagattggacttggcagcactggtcatgtctgttattaaatttaatctatcttattgtcttctcattgattaacagtggtctaagacagtggttctcaaccttggcggcacatcgaagctttaaaaaaaaaaaacaaaacactctgcatctaggcttcaccccagataactcaatcagaatctctggcaatagaacccaggcatagtagtttcttaaaacttcccagatgatagcaaagtataaacaaagttgagaaccattggtctaaggaaagtctttttactctcttaaactttatttctaagagtgattagatactataaaaatattttattgtattcacatatgtgtcacatgttttctaccatcttgctgaatttctaatacaatgttaatgaaatagtgtcctcttctaggaatttaacttcccatgtgaaacaatttatgccacaaaaccaactgaaggctaccaatcatttggtatttattcttggaaacattgaacaactcaggtctgggtagattggacagtggtattaccattaataatccagaatttaaaataaattaatttttttgagcctttaactttgttctctctttgattaaataatttctaccaatttgtataaaatgttaaaaataagatgttgatttttaaaaaatcaattacaggaatttcaggacagtatagctcttattgaagatttacaaccattttcaacatacatgatacagatagctgtaaaaaattattattcagatcctttggaacatttaccaccaggaaaagagatttggggaaaaactaaaaatggaggtaagttatgggcttgttgtgggtttctcaagcagaatattgtgatatatgtgctgtgtatgttgatgtttattttttaaaatctgaatgcgaagtaattttagtaagcttttttaagtttaataagaaaaatgtgtttgtagaaaactttgacctgacccttactctaacccctgaagctaactaataatattctattaaaatagaaagcaactaggaggtaaaacattgaaatcaatattgtttgaccaagaaacacattatttggtctcaccacacagtgtcactttttccagatactcataggtttctgtacatgtggtgagctatagaaaaaccaagctttttttctatgtgaattttactgaggcctgagctgtaaagttatgcaacagtatagccttaaagaaaataggtctgaaaaggttttctaagagctgatgaggtggtgattattatgaggtgatgacgtttatttcagatgtctctgatgatattcacaaaactcacccaaattgggttattccccgttggccatatccttgagctggagtcagagaatgatttggtcactgggcaaaaataagtgggagccttttaggcagtctgttaacctacgattatagaagaggctgactttctttctggacatgtgttatttattctgctcataccacatgattactcttcaacccaaactccattacttctttccatctttcagtgctattgcagcatcctttatcattccttgctatttatttcagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggtacagtgagtttactaggcactctttattgtcattctcaagtgcaaggctctcaaaaggttaagcaattgttcttttttaccaaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaaggtagacttttaatgcaagtctttattttatgatatagaataaattggaaagggctttttcatgcatctagaacatgctcatgtataaataaacaatatatttgacaactttcattgatttatgtttggcatgcagaagcagtgagttatccagactaatttctggtgggaagaattctcagggagattaatttgcttttaaaaggctttatgtaaaagggtataagttatagtgtactaattttataatattttacttagtttagatgttagcatggttctctggtttaaagtccatagtaacttggtgttttccatgaaaaaaaaatgaaaaagaactgaagaaagaaaaaaccaaaaccttgtttagaaatgttctttcatcattttaagggctgtgcagtaacaagagagaagtaaaccataaaaccagcttattctaaagtagttttgttgttggcttgcaaactttaaatgattcctcatccaaaacttttcacgctttaaccaataaggaagcacccactgaattttaagtcatcaattaacctgattaattcattgatggggaaagcctacattgacttttatggtgataaactcaaaattgattattaattttttataattgctacttgttattttaactattatatatgtgcatgtgcatgtttgtatatttctgggcctatgtatgtgtacgtgtttttaaagattaattagaaatgttttgttcagtggtaactcaaaagcaaatcagtataatcatggcctcactacttcttaaaatgcagttattccccaggatgtttaaaattattatgtaaggtatttttgtgatcttatactttatagataaaaactatgaaaactgtggaacaacactgaatattgagttgataaactcaaagaccatagtttcattggactttttctgttgagcatgtttctgataatttgttgtctatttaaaaaattgccaccttataaaaatgcagttaaattggagaaattggaggagtgccttttaaaataacatctattttagtaaacttaatgcagttcagtctaaaaccaagaggaaggatgtaaagttcatttccaagattatcaaagaaatgaaatgggaaaagacttcagagataattgacaccctagcctctcattttattgatcagaaatggagatctagacagatgccagatgtcaccaggcagagaaaaaccccagggctgacttctccctacagcagtcctattagggtgctgtccgtggaaggaataggagtcattaagtcatccatcccactctttcaagtttggggagaaggacagcagacagagatctcctggttgaattctcatgactttcatgcagtgctttttgtttctaaacttcctctgttttcacatttgctcaacacaggttccaggcagaccatttagaaaatcatgaagctgcaaatacaagatagagtcatttgtacatgagtggccatctacaaatactaactatgagtacagtaaaagtctgtggttctgcaagggttgatgagtgctatatagtcagaaagtgctgtctcttttgaacaacttgagcctatctcacaatgacaggacagctggaaataataccgtaactgcatactgaaactctgaggagtgggcaataaaagagaatatttgtctctttaattagtaatgttttagaaaggaaacaggaagaaaatgataaactttgtctctgtcatttctgtcaaaatttccttatctgaaaaatgagggaactagagcacaagatgaagtttcgatctagatcaggggtgtccaatcttttgtcttccctgggccatactgaaacaactgtcttgggccacatgtaaaatatactaacattaacgatagctgatgagctaaacaaaattccctaaaaaaattcataatgtttaaagaaagtttacgaatttgggttgggctacattcaaagtcgtcctgggccacatgtggcccacaagctgaaagttggacaagcttgatctagatcttaaattctatataatacaagaaactcacaacagtgtatagaagaagaacatatttaaaatggggaggaaacaaataattttgtttggtaatttttttcacggaagtccattaaaattgtgtttttctcagctgttcaggcaaatccctagcagaaccataagtttctgaagttccaaactctcagacatcttagctcacactccccctcactcccacccacataatttgaaaatccctctatggtagccttcacccctgcacttgttggcttctgacaaatggaaagtcctgacacccttgtgatttactgggatatcctgtggcacctctccaagttggtggtctgcccagacactcattgctgtggtgatgccaacactctaccattttccagcggtaagcttggtcaaacatctcctgacatttcaaggagctctgataatttcttgatggtttggaatgttgggttacctagactattcactataggtaatttctccaccagataatgaaggagacagaaccataaagagttaagactttttttttttggccaggagttaatttctctctctctgaggttcacagtaaatattatggattcaatgcacccgtttcattaagctattaagctaaatgtctcagcaggattgatacatttatgagtttagtgcaggcaatgtccctgacatcagcagttctatttttttaagttttcattccttccattcccttattcccctttcttactgtacatagtggtctactgactgaaaatgctatagagaatcattccttactgaatagaaaactaatataaagtatccatttaatgaaatgatgtgacctcatgagtgttaagtgaaaaagaagatataaattaagtttatttatggaaactgacctttttatgaaactctacagggaaaatacaccaagaacccctgacaaattgccatatctttttgtcttttcctatttgtatgttaagaaattatcattttcaaataatgatactaaggatccaaatatacagatttttagaaagcaatgtcacagagcaagaaatttcagatagctgcaattagaggcccaatatctaaagtggaatgaaaacaagattttctgtatttagcttctagccttgctacttagtagcttcataatagtgggcaaaatttttcttcttttggctatgtaggcttccagtatataaaaataaagaattctgtttacatgtctgaagagggtgttaggaggaaaaaaaagtcttagtttgtaagtcactgtggacttctttatcaaaatatgtaatcaaaacatgtaaaaatattattgctatgaaattaacaaatccctgggatttgaaattaccattgttttgatccatcattgtcccacagctatggatttgcattcttagccatcctgattaaatgtaggtatctaccctttgggataacaagaagtcatagctctgaatcttcctcgttgacatatagtcagaggtgtatgtcccactttgagcttctcccatgaacagtcatgtaaatcagttatatcttgtcataaaaagcaaaacgactataggcagtggggtaatgtttgggatcattcataaagaagttcttattctttaatagaaaagaatgcttaaattttaaccacttgctataagcctatacatttttgtgttttaagaatattttcttagagaaacaaaaatattaatcgagacttctttttctagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaaggtgagtactaacatactcaatactcagaaaactctgtgtttcagtttttttcttatcacttatttcactaatcctagagatatatgaaattgttctttaaaagcagtacattattatttctagaacttgaatgaagaaattcagaaaatataggagaccttgcaggcagtaatgaaataatactggctgggtctggctggatcctgaactgggcaaaattacttcttctttcagtatccttatttcatgtctagctatgacaattttatggtgataactatatgaaaatagtgttactgaatgttcaaaaaatatttattggctactatatttgagatactaggatgaaaaatataagaagttcattaaaaattaactagtgttctgaaagatataccttaactctgagatgagctctataagaatggaaggaacaaagatctagaaccaaaaataccatttgacctagaaattacattactagttacatacccaaaggaatataaatcattctattacaaagatacatgcacacgtatgttcactgtagcactattcacaataatgaatcatttggaatcaacccaaatgcccgtcaacattagactggttgaagcaaatgtggtacatatacaccatggcatactatgcagccataaaaaggaatgagataatgtttttttgcagggatatggatgaagctggaagctattaacctcagcaaactaattcaggaacagaaaaccaaacactgcgtgttctcacttacaagtgggagctgaacaatgagaacgcatggacacaaggaggggaacaacacacactggggcctgtcagggggaggggtggggggatagagagtattaggaaaaatagctaatgcatgctgggcttaatacctaggtgatggtttgctaggtgtagtaaaccaccatgggacatgtttacccatgtaacaaaccttcacgtcctgcacatgtaccccagaactaaaaataaaaaaatttgaaaaaaagaatggagggaaaatgctccaaaacttatgatagttttctttattttcatttatcacttattttgtttcaagttgagatatattgttaatcttatcaccaattcatcaaatccatcactaataaaaacttcaaatgctcatttaaaaatatgtaatcatataagaatatttctgaatatttctttttttaaaatttcttcttaaaaaataagatacatgtgcagaacgtgcagggttgttacataggtatacatgtgccatggtggtttgctgcacctattgacctgtcctctaagttccctcccctcagctcctatccctcaacaggccctggtgtgtgctgttcccctctctgtatccatgtgttctcaatgttcaactcccacttatgagtgagaacacgtgctgttttgttctctgttcctgtgttaggttgctgaggatgatgacttccagcttcatccatgtccctgcaaaggacatgatctcattccttcttatggctgcatagtattccatggtgtatatgtaccacattttctttatctggtttgtcattgatggattggcttggttccatgtctttgttattgtaaacagtgctgcagtaaacatacatgtgcatgtgtctttatagtagagtgatttatactcctttgggtatgtactcaataatgagattactgggtcaaatgttatttctggttctagatccttgaggaattgccatactgtcttccacaatggttgaaataatttactttaccaccaacagtgtaaaagtattcctatttctccacaccctcatcagcatctattgtttcctgactttttaatagttgccattctgactcgcgtgagatggtatctcattgtagttttgatttgtactcctctgatgatcagtgatgttgagcttttttcatacgtttattggctgcataaatccctttttgagaagtgtctgttcatatcttttgcccactttttgatggggttgtctgtctttttcttgtaaatatgtttaagttccttgtacattctggatattagccctttgtcagatggatagattgcaaaatttttctcccattctgtaggttgtctgttcactctgatgatagtttcttttgctgtacagaagctctttagtttagttagatcccatttgtctattttggcttttgttgccattgcttttggtgttttagtcatgaagtctttgcccatgcctatgtcctgaatggtattgcctaggttttcttctagggtttttatggttttggtttttacatttaagtgtttaatccatcttgagttaaattttgtataaggttaaggaatgggcccagtttcagttttctgcatatggctagccagttttcccagcaccatttactaaataggagatcctttcctcattgcttgtttttgttaggtttgtcaaagatcaaatggttgtagatgtgtggtgtaatttctgaggtctctgttctgctccattggtctatatatttgttttggtaccagtaccatgctgtgttactgtagctttgtaatatagtttgaagtcaggtagcatgatgcctccaagtttgttctttttgcttaggattgtcttggctacatggggtcttctttgattctatgtgaaatttaaaataactttttctaattctatgaagaatgtcaacggtagttagatgagaatagcattgaatctataaattactctgggcagaatggccattttcatgatactcattattcctgtccatggggatggaatgtttttccatttatttgtgtcctttcttatttccttgagcaatggtttgtagttttccttgaagaggtccttcacatcccttgttagctgtattcgtaggtattttattctctttgtagctattgtgaatgggagttcattcatgatttggctctctgcttgcctattgttggtgtaaaggaatgcttgtgatttttgcacattgattttttatcttgagactttgctgaagttgcttatcagttcaagaagtttttgggctgagatgatggggttttctaaatacaaaatcatgtcatctgcaaacagagacaacttgacttcctctcttcctatttgaataccctttatttcttcctcttgcctgattgccctgaccagaacttccaatactatgttgaataggagtggtgagagtggacacccttgtcttgtactggttttcaaagggaattcttccaggttttgctcattcaatatgatattggctgtaggtttgtcataaatagttcttattatttagagatatgttccataaaaacctagtttattgagagtttttaacataaagggatgttgatgttgaattttatcaaaggccttttctgcatctattcagataatcgtgtgatttttgtctttggttctgtttatgtgatggattacatttattgatttgcatatgttgaatcagccttgcatcccagggatgaagccgacttgttcgtggtggatatgttttttgatgtgctgctggattcagtttgccagtattttattgaggatttttacatcaatgttcatcaggtatattggcccaaagtttgttgttgtgtctcttcccagttttggtatcaggatgatgctggcttcataaaatgagttaggaaggaattcctccttttccattgtttggaacagtttcagaaggaatggtaccagctcctctttgtatttctggtagaattcagctgtgaatccatctggtcctgggctttttttggttggtagtctattaattactgcctccattccagagcttgctactggtctagtcagggattcaacttcttcctggtttagtcttggtgtatgcatccaggaatgtatccatttcttctagattttctagtttatttgcatagaagagtttatagtattatctggtggtattttgtatttctgtggggtcagtggtgatatcccctttatcattttttttgtgtctatttgattcttctctgtctccttctttatttctctagctagtggtatattttgttatttattttattttttaaaaaaaacggctcctggatgtgttgattttttttggagggctttttgtgtctttgtctccttcagttcttctctgatcttagttatttcttgtcttctgccagcttttggattagtttgctcttgcctctctagctcttttaattgtgatgttagggtgacgatttgagatctttctggctttctaatgtgggcatttagtgctatgaattttcctcttaacactgctttagttgtgtcccagagattctggtacattgtctctgttctcatttgtttcaaagaacttatttatttctgccttaatttcattatttacccaggagccattcaggagcaagttgttcaatttccaggaaattgtgtggttttgagtgagtttcttaatcctgggttctaatttgattgctctgtggtctgagagactgtttgttatgatttcagctcttttgcatttgctgaggagtgttttacttccaattatgtggtagattttagaataagtaccatgtggcactcagaagaatgtatattctgttgatttgggctagaaagttctgtagacatctactaggtccacttgatccagagctaagttcaagtcctgaatatccttgttaattttctgtcttgttgatctgtctaatactggcagtggggtgttgaagtttcccactactattgcgtggcagtctaagtctctttgtaggtctctaagaacttactttgtgagtctgggtgctcttgtattgggtgcatatatattcagaatagttaactcttcttgttgaattgttccctttaccattatataatgcccttctttgtctattttgatctttgttggtttaaagtctgttttgtcagagactaggattgcaaccctctttttttttttttttgctttccatatgcttggtaaattttcctcaatccctttattttgagcctgtgtgtgtctttgcatgtaagatagatctcctgaatacaacacaccaatgggtcttgactccttatccaatttgccagtctgtatcttttaattggggcatttagcccctttacatttaaggtaggtattgttatgtgagtttgatcctgtcaccatgatgctatttggttattttgcatgctagttgatgcagtttcttcatagtgtcattgatctttatagtttggtgtgtttttgcaatggctggtaccagtttttcctttccatatttagtgcttatttcaggagctgttgcagggcaggcctggtggtaacaaaatccctcagcatttgcttgtctggaaaggattttatttctccttcacttatgaagcttagtttggctggatatgaaattctgggttgaaaattcttttctttaagaatgttgatgttggcccccaatctcttctggtttgtagggtttatgttgagaggtccactgttagtctgatgggcgtccctttgtaggtaacctggcctttctctctggctgcccttaacagtttttacttgatttcaaccttggagaatctgatgattatgtgtcttggggttgatcttctcgtggagtatcttaatggtgttctctgtgtttgccgaatttgcatgttggcctgtcttgctaggttggggaagttctcctggataatatcccgaagggtgttttcccacgtgtttccattttccccatctcctcctggtactccaagctatcataggttcagtctttttatgaagtctcatatttcttggaggctttattcattccttttcattcttttttctctcttcttgtcagcatgtcttatttcaataaggtagtcttcaaactctgatatcttctcttccacttggtcgattcagctgttgacacttgtgtatgcttcacgaagttcttgtgctgtgtttttcagccccatcaggccatttgtgttcctctctaaactgattattctagttagcaattcctccaactttttatcaaggttcttagcttcttcgcattgggttagaacatactcctttagctcatcatagttttttctacccatcttgtgaagcctacttctgtcagttcatccatctgatcctccgcccagttctgcacccttaatggagacattgtgatcatttagaggagaagaggcactctggccttttgggttttcagcatttttttcattggttctttctcaccttcgtgagtttgtctagttgtggtctttgaggctgctgacccttgtatgggttttttgtgggggcccttgttgttgttgttgatgatgatgctgttgttgtcactttctgcttatttgtttttctttcaatagtcacttccctcttctgtagggctgctgcagtttgctggggttcactttaggccttattcatctgatttgctcccacgcctggatatgtaactcaaggaggctggagagcagcaaaaatgggtgtctgctccttcttctgggacctctgacttcaaggggcaccaacctgatgccagtaggatcgctcctgtatagggtgtcctgacaatccctgttggagggtctcacccagttgggtggcaccaggaggaggacccatttaacgaagcactttgtcccctggtggagagggtgtgttttgctgtgggaaagcccacttgtctgggcttcccagattcctcagaactaccaggaggagaggctaagtctgttggtccgcagagactgcagccacccctccccctaggggctcaggcccagggagatctgaattctgtccctgagcctctggctgcagttactgaagattctgcagggaagccccacccactgaggaaggatgggtgagggttagacctgaagaggcactctggccgctgactaccacagctggtgtgttgggttgtggcgacaagtcttgggaccaagctgtccagcctcgctggctcccgcaggggaaaagcacagcctggagctatagaaatggatgctgcatttctccccgccgcccagggagattagcgtgttaggcagttgggagtcccagtgctggctgctgcccctccctcaaggagctcaaagggcttagacagcaggcagcagaagcctgtgctggtcacccctcccccagggagttcagtaagcttaggcagattccagctgagaggccataagaatctgtacattctagggttgggatgctaggcctcggtggcatgggatcgagagtgggatcttccaatccatgagttgcacagttctttggaaaagcaatttccccggctgggtagcctgctcgctcgccgctccccttggctggaggggagggggttccccttccccgtgtggttctcaggtgggctcactgctcttccttctctctgtgggtcacgccagccttctagtcaattttgatgagcgaatctagataccttgccggtgaaggactcacacacttattatggtttttttcaataggaacctctgaacggagttgcttctagtcggccatcttggccccgcctctgaatatttctttaatgttgtctttcctcttaatatattctgtagaaagatttcagtgcagaagattaatacttcaaacatatcaaccaatattttctttttttccctaaagctggagtcccaaataaaccaggcattcccaaattactagaagggagtaaaaattcaatacagtgggagaaagctgaagataatggatgtagaattacatactatatccttgagataaggtatgtgtgtttgcaaagtacttgtaaatgacaaagaactaagaagataattataaagtaatcaaaagtaacactatttatgcaaatgtatttatatacaaacacaaagatctttagttaaaggactcacatgcatcattacgttctttgctcaattcctagacgttggtcttggcatgctaattataaacagatcacgtcattctcagaaatctctaactgctcattgacactttatggaaattgtttgatcataggctcatgcaaccagtattaacttaatatcagttttgtttaaaaagcttagctgatgtttaatgttaaataatgatggcatgtaaattcctgatgataatttgctttagcaaggtgaatactctctagtgagaaatggtgatgaagtagatatttctcatactgtaaaattaggtcaggttctgaaatggtctgaagtgtagaggtcacacaggattctgtattcattgggaagattacagtttgcaatgtgttcccagggactgaaaacacaccgtcgatgaaaaccagccactgatgaacagcctcagacctggccagtacggggagcacgtgaaccataactggcttagaaggactgatttcatgccaacttgaggggagaattccaaattccaaagacactcctctcacaggactatgaaaccatcttttaagaagttccaaggacaaaagtcacttccataattatagtcctggcaacttgatctttagatctatttttgcttcatctggctctggcattcccataaccttaaaaaatgttcctgttcatactagagaattcccttggcccttatttctaattgaaacctccttgaagtttctgttgctgcttttcatgcagagtgaaatacattctaacctgcagaactgtcttggtggtttgtgactgtaatgatgttcatcaatcaggtcacacatcaggtttttgctaggacctcttttgtgtgttaccctgagtaacaccttaagtgctactaaaatgactccatctaaatactttgcatactccttgctccaggtctccactgtcaggacatagactataggatgactgaatgattgttgtaacttcagtgtctcaaaataagtccttcagtcaggacactctagttagactctgtgtactcactgatggggtagtggaagtgcaaagtgcatgaacttgggagttgaacaagccttattagtttccaagggttgccacaataaaggaccaccaactgggtggcttgaaacagtagacatttattcttacagctctagaggttagaagtctgaaaccaacgtatcagcgggactgcttgttctgatggttctagggcagaatccatctttgcctcttagcttctggcgtttactggcagtccttggtattccttggctcgtaggtgcatcactgtcatcatcacctcctgcatcacaaggtgttctctgtgtccaaatttccctcttcttatgcaagtgccagtcattggattagggtccaccctaaactactatgacctcatcttaacttgattacatttgtcaagatcttatttctaaacaaggtcacattaaaatattctgagtgggtatgaattttgggaggacatgactcaatccagtacacaaaccatgtttaaatgcttgttcttttccttttttgaacttaagtttcctcatctgtaaaatggagatgataatatctatcttatctctttaagctgttgtggactcagtgaattaaaacaacgttatgtaaagccccagtacagtatgttgtaaatagaaggtgctcaaccaacatcagaattcttctttcttttctcaatggccattgtgtagagccacttcacaaattctcaagggcctctttcttttggatcagagttgtttggttaaacagtgaaatggccaatgctaaaggtgagacgtcacaaaatgtgtaaaaacactctgtcctaatgctttgctcaggatggtccttaaagggaccctcagctccggggaacagctgtgaccaactctgctgccctgctgctcccgatgttcttaccctttccctgcctcttatgagggccagccttcactctctgttggtcttcagaaggatgagtcaattagcaggaatagaaccagattctcccacatatccctaagcttaccgtggattggcaccaagtcctaaaactattgcggtctgaaaagtttcagacctgaaatattcttcattgttagagaagacataatggaagaccttgagcttgcctttgatgattctgtaaaaagtcattccagttatgtcttttgaacccagcccttgtgctccttccatgtttcaaatgaaaaacaattggattgactttgaggtggaatgtaggtcaatacaaaaggaagcaacgagcctcagaatctcagatataatgataactttggtagctgaactgtcacactttccttatcaattttgtattctgtattttattgaaatatggcataagtaaactacaaataatgtaaaagactgaaaattgagaaaatggaaacttcccagttaaaaatcatggaataattgtcttataggtttggaattctggagaaagtttacccatgctgttagtataggaaaaaggtactcagctctctcttcaccactgattactcacagttttcttggtgggctgagttaattggctccatgcctcactaggatcactataaaaccatgctgttagcatctgtgttgccagattatgggagaggaatgaggtcaagggtaaattgtgccaaaggacactctctggcgttcagtcactaagaagatctatgaacaactagaaataacaggtatattgtcatgtatattttctgtatttattattttttgcagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggaggtatgttaccatgtctgtctacacactagcttattacctaaaggttcagtaataaatatcagtacattcttaacattagcaatagataatggtgactatatatatatatatatatatatatatatatatataatcttattatccaaactattaaactattccattcatgtgatgtgatctttctaaaacatcattatcatcatgtcatttttctccccaataataatcagccacccccttaattcctaccacatcaattccatgctcctaattaggcttccaaggctgttcacaatctgttctatccagccatataattctattcacattataccagccttatgaccactcctacattatacataacaggcctaagacctttgtttcttccccaatatctacctcttccactgtgtattttattttagtttatgatatattgtctttctaatcacataggcaggaaatctcagtgccatatgtgatttttccctctactcagtaatcaggtcctgttgattttaccatcttgatttttctctgatgagttctcatcttcctctttccaccttggctttcctaatttaaggtatcatttcttgcctgtgcccttgacttacgcatactgctgacagttaaatttagttgaagcacaggctggattacttaatccctctctgaaatacccacaatggctctccatttactgctttcagaatcagctacaaacttctttgtggcatgtgaggtcttctgtaatttatcctccaattgtggtttatcttttccaatatttatgtctgtgctgtagccatatcagaccagtaaaaagtttttatgtcacttagtctttggccctgtgtttgcctcagcctagaatacaggtccccactacctaccctgtgccccttagctgtgatttcctattatttattttctgccaattgaaattcttctcatccttcaagacttaaatgaactcatcataatgcttacctgatgctccttagtcaaatgaattattgcattttatacactcacatgctatataaaacttacatgattcttgtttatattatagttagttatctagttagttgtgtacagaagtttgctacccagctcagcaaactttttctgaaaagaaccaaatagtaaatatgttagactttgcaggctacatgtgatctctgtagcatgttcttcttttcttctttttctgttctctttttccttctccttctttttaaaaataacactttacaaaggtaaaacttattcatagctaatagggggtacaaaatcaggctatagccagatttggtcctcatgccatagtttgccagactctggcctacgtgtttgtttcctctacacaactgaaactacctaagagaaattaccatgtttattcctcagtttaatatccatgaaattaaatatgtatgaagatattatacaaaataataatgccaactatttagtatccaaagactgagatttcttggtcctaaatttattaaaaagatatatatgtttcctaagtcattttaaagtagaagattgagtggatatattccagtggtttgttgctctctgcaaaaaaaagcaaaaacaccttgcttttgatttcacatggcataaacactgtctgtatggatgctttcaagctaccaacggtctaacaactggcttgcaaaaatccagtagtagctagctctgctatattactctgtgtgcttaggtagagctggggcaacttagcttttatctatgaattaatttctttttctgatttatattattagatgatttttggataccagaaacaagtttcatacttactattatagttggaatatttctggttgttacaatcccactgacctttggtaagtataatagaatttttaaaataggcaacaaactgtttacttaatcatacctgattgatttatctcttagttgatctaatctcccacatgaaatattgcctgattaagttaataaaatttacattgttacctttggctatacatttataaccactaacttctgtgaattgttttctgatctaggcataactattttatggaaaatatacatgtacatttcatgttatactttagataaaactacttgcaagggcaccaacttttaggtttctttaaaacagtatttatttctgattggctgcatacaaatgttttgtggcttatggtttaaaataaataaaagaaaaataaccctgggtacagaaaaaagtatagaattaatgggaggccagtgacaatctttgattgggatagttttggtttctaagcagacaggctggtttggaatgagtagggcctcttttgcagaagatccatttctggcttgtgggatcgactcttgctttcagacatctgatctgcttatttcaaatccctgctcatttataaatgaccaggaaggcagaaaaattaggttaggtagatagaaagctattttttttctaagaagatttactttaatgataataaaatgcagtaaaaacctcaaagggaatggtcaagtactgattggacttttagagttatcacagtgatcatacattcttgtttatttctgtttcagcacaaataataatagcactttctttcattccccaaactgtccgagtttgcttataagatatatggacccctatctattgctaatattgagagtccccaacacactgaatcattaaaagaagggcatgattcttaccagaaaagaacactcaaacacatattaagaaagttgtggcttgttttgttcacaagtaggggtaagttacaagggaaagttgatggaaaagtcacaaacataaagttgaactctcaggataaagacagccaacactttactgtgttctaagtctttattctttctgcaaagtgattggagtcacaatctttatgagagcactttgaagctcgatttgagatttttttcaaagattccacccagacaatatgtgaaactccttcagcaaacttggaaagctaaaaatttcagctgaccctgccaggattttaacctgtggttccagagagtctaagtattgcacagctgatgtttgtgccactaagccagcccctccagacttacgcatatgactgcagtatatttggcagttggcatataggcttgactgcttgtctgctttcctactgggaaggagaattacatgaagaatccttcagctgacctttgcttgctttcttgtacatcaccattgtttaaacccataactctagtggatgaacatgagataatttcagacaacctattgtgcttccaagacatcctatggatatctgactttctcaggacttaaaggtctttattctgtttgaaattcacgaatttttgagtctagctaagctaattcggttctttgcttttagcagcagtgcatgtggttttactagtaagagcgtgtgtgtgcatgagaaaagattgagtaattaaaataacaaaacagtcacaattattttaaaatttgtattgtgctgagggcactcatcagttataaacataaaattagacaatttttaaaatgagtgttgacagcctttgcttctgagcagtcatatctaatgcataacattagccttctgctgggagtaggggaaaatgtaaacctgtaaaatacaactgctgacctcaggagcttgccatttaatgagggagttaagacatgcctgtgtgggaagacaaatagcaagatatgtgttaaataataacaaaagacaaaaatagatgaaataagtaagacagtgcataggataagcactcacagagaggcgcaattagtctttcaagttcagatatgaaagattagtagaggttgctgaggtttcagaaggcatcattgaggatgtgggcttacattgggcctttaaaagtgaagcgaggtggtgagaacatttcaagttggaaaaattaatttagcaaaaggtacttgtgatctttcactgtgtagcccttcaaattgaatttcatgtgaataaaactctaacttcttgaacatagaagctactgtgaaattaagttcaaattttaatgatcatctctcaaagcatgcttgctgctttcaacttctgagccaatagtccagtacagatgacaatcctattgacataattgtattttaatattaaaaaaattttattattataaaactaatactgcttattatataaggaagacagtacaaattactcatgattctacaactagggcagaccactgctaacatttggtaagcttcgttccaatactttttctacatattcgagtatgtgtatatgaacaacaatgataaacactcttgtactctgcaaaaaaaaaaaaaaaaaaaattgccattatactgaaagcattttcttttctactgaggaatataacctggatgtgactgaactcaaaaatgaatttgtttcactaataattatgtttgttttggtttattttgactcgtttatgggtgattttgacaaataagttttaatattaagatactttaatttgtttataacaacagtaagaaatacattaaattttaagaagtgagattaaaaatggtgtagtatgatttgtgtacttatatatggctttttacctggatttaattagttttttataagatattttaaaatcaaattatgaaaacttctataactattctactgatagtgttcttgcataaaaacacttcaaatgcactgttaacatttcctaaaggaaaaaagaagcaatattttattttgtaaattatgtcattttttcctttatagtctggcatagaagattaaagaatcaaaaaagtgccaaggaaggggtgacagtgcttataaacgaagacaaagagttggctgagctgcgaggtctggcagccggagtaggcctggctaatgcctgctatgcaatacagtatgtagctttggccatcattatggagcacctaggcaaagggtgggcaacagtaaggagagtgcctatgaattccgcattgcccaagacagtcatggtttataccagtttttctggcataattattaataacttcctcttccactctcaaatgtgacctgggatggatggaaaattatgtggttttaagaaaaatacagaaaaatccattagtttccagtattttgtcatgtagctcaaaaacaaatgaaagaaggagaaaaatattacattgaagagaatagatggtaacatggttggttgacctggaggcagtgtttgagaggagaggagttttgagagccttgtgttacgtggtcagccttaagtcaatcttactccatttcagaagttgtgtgatgattgcccacaaaaccttcttaagatagatgagttttgaacttttgttgccgtcataattaaggaaaatattcaagtgtcttatgcaaaggttcattatattaggatctatgcaaaaaggaattaaatgatcataggccttgctttcagaaatttataatgcaaggtgtaaaaacaaaggatttgaagtagacacaaaggtgatctaaatcagctgtttagaggtgactttcctttgagcaaatactcagcatatctgctactcaagattctctattaaaaattgaaagcatttttaacatagcagcattttccccccttgtagtattccaagtgagaaacttggctttttaaagttaaccttatggtgatggggttgatttttttggtcatagtaaattttgttttacgtaagatgtcacatgtgtgaaatagctaagagaaaagcttataaacccagatgcatttattactaatttgcagtagctttttatacaaattggcaatctgaagaagttaatacctactaactttgactcaacaagctacaataaaagtgttgaggcaatgcatacacatatatatttttatcaaaattaaggtgcctagaagtggaccatcatgctctgtctgggtaaaaggttgtagaatagtaaagtaaagtaattaggaacccaaagttccacatcaccgtgtcacataaaacacacaatactgcaaagccatgagatatttctttctctctcaaacacaaataccaataccaacacaaacttgtacaccctatatatgtggagggtggggagacaaaaatgttgctattttacagtactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaaggtaatgtgaatcttcgaactccttgacacattatatcaccatatctacaaagattgacctggatataattataataaaagttgagtgctctttgttgaaaagaggactggttgaatgtcgaagcctatccatagctacagaaatcacatttaaaaaaaatcatttcctacataggaacattgtttgtaatcaacaatctccagggtttgcattacctctaaggctactaattagctaagacctatcaggcaatcatttttcttcaaacatgccataagagaactggagttgtgaaacacattcttaaggtactagaccaagggtcagcaaaccttttcttaactgggcagatagtaagtattttaggcttgctgaccatacagactctgccattgtattgtcatagacaatatgtaaataaatgagtgtggctgtgtaccaataaaactttacttatgaacactgaaatttgaattttatattattttcatatgtcatgaaatagtaatattcttttgactttttcaaccatttaaaaatggaaaagccattttcagatcataggctatacaaaaagaggtgacaggctggatttggcccacaggctgtagtttgtcagtctctgactacatgattatttatcatagtatacttaatgtatttttaaggaagcacttgatatactcatatttttgcaaaaactttcttttgataaagggaggatgaatcttttatgtaattgagcaatatcctgatctctgcttattagagatttattgctttgagagtgagctatacaactagaaaagttggcaaaattctctctgcttctaaatgatgtcatttaaaagttctttaatttactcccaccttgactgttttaaacaaatgtttatttctctcatgtaacaagatgactgctggctttggttcaggatagtgtgtcaggtcagagccagtatctctgaaattttcttggctgttgttcatgcttgctgcctcattgttccaagatggctgacaaagaagcaagcatcacatcttcattcgggccagggagaggaggaaagatggtgtgagatgtacatgttcaggaaggcaaagtcttcttcaaagctcccttcccgcctcagcagtttttctcttatatgccattgaccatcaccgagttatatgaccaccccaatttccaagggaggctggagaattttagaatacaattttcatgattagctttgatcaattgcttgggactgggaacctggcctccaagaaataaatcgaaagcaaggagatggagaaaacatattgaaaagaaaattttgaaaattaagaaattggcctaaacaacaaaacttggtctcttaaaatttctaccttttggaggaatattgtgtaaacattactagacctcttattttgcatattcttctactagcaataacaggaggtaacatttgaagggtttgtagaatacatgcacatgttttatctacgatctgtttccagctttcagggtagatattacagaacaaacagaacaatctccattaacccactgagctcacagaaatgtctgctatactgattcctgacttgtttttatgttgtatagactttgaagaagggttccacagaccaggagaagattgaattcctgaaggaggcacatctgatgaggtagctctgaaataattttctcctggtatgggtaagaagttttaagtccgcttgacttatttttaacacccaaaatgacatgacttaacggatcatgactaaaacaacatggttgaaacgtttaaatggaactacatctgcagagcaagtagtctatagaggccaatcttctgagcctgggtacaggcaatcctcagacaaaaggttctcctttcttttatcttcaataaggagcatgttttgcaaatgaattctgaagctgtttggcttttgacatgcttgtattcatctaaatgtgtgataatggtcaagtatacccagtaagagagagttctctcaaatgctataatgtcagtgaaaatatcctttgtcttagtaaacttgtctatcagtttgagtttgtggtcataaaaactgctcaagcacatcttaatgggaagacttgaggcagtggttgattgggtctcaagctgtgggttccaattattaggttgggacttacttggtttgatgtcttgagaaaactgtgtagccaaacccgcatttctgagttgttttcctgaaagggagaggatatatttcatacctgtaatgacccaaaacccaatgtttttaaatatcttttcaaggacgctactagtcaaaattactttcttttccaaaatatgcttaatacaaatgttattccttctaaaaaccaacctattttatccatactcatggccactaggggttgccatattacctctttaaggtaagcacaaagaccaggagttggaaaacgaagtgttagagacactaagtcaggggttttgaaggaaactattgataaagaattgctgtactccataaagaccctcggctaggactcctgcttctgtcatatcatccagcctgtgtctttccacctttcagcaaatttaatcatcccaacattctgaagcagcttggagtttgtctgctgaatgaaccccaatacattatcctggaactgatggagggaggagaccttcttacttatttgcgtaaagcccggatggcaacggtaggcagttgggatccataatattggtttcataatgcaaatgccctataattccctattaattttctttaaatttaataggctgcagtggtaaaaccttagaagacttacatggaaagaattattctgtttccttcacattagcttttgacaatcagaaccctgggctaacattctggcactttctggtcatgtgagcccgagcctgtttttagtatttaatgggagaacatgaccctcattgccagaatcatgtttttctggagcacagggatagcgtggagttggaaaggcatatctctgtacttaatctatatgcctgtctgtcccaaattatatttccagtcttgatgtctttactgagtaccagacttgtatgtccctctctagttgacatatctttttggattttagtaggtatctcaaacatattttgccccaaacggagctcttgatttcgtacgtcctctcctactccacccatctacttccttgctttctctttccctacatccatgctaacaaactctgcctgcaaaacgcagccgcagtccttcttctcttgtatccccagtgcctggagcagtgcacagcacattatgaaccctggaaatactgtggaatggcggacaggactgggggtgactacctgtaggaatctaccttataccttagatgagaacacgtaagataagacaagtcagcaaagtttaaatctggtggattaaaaaaatttttatatcaaaataaacatcatatggctaaaaaattaaaatgtgtgacaaagcatatagtgaaaaacaggagccctgtgcactgcctcattcctacctctcaggccccgcatgtatcttgtggtatttaccgccaagttcctaaatagtctgctcatactgacacatgttgatttttcaatttggggtaaattgattgcccagtatggaagatgaggatttaactctcttagacttcctcataatatacctgtccatccctcaccacgctacacacaggaaaactttgcttgcctcatcctctgacaattatcacaattttgcagataaaccatccttccaggtttgcattattagaactatttagttattattattatttttagagctgaattatccaaatgttattaatgtaagtttttttctcaggctagtttaataaatatctcttgttttcattttagtttttatatacgtaaactccccaactgaattgtaacacttttctcaatatggctaacagtatcagacaatctagtacttaattttttcttggacacttccttcctggaagcagtgtggatgcttgtgctctaggctagctacacagctgctgttctagggtttccttcacattcaacctgggaatcttcctcaattcttgtccatgtgggactttttccatgtatctcatgactttttgtttgttttagaagagaaagtatgcatgtgcagcaaaaatctgcttttttttaatttttgagaaaacgtcctttattcttccctcacacttggttgataatttggttggacttttaggttgaaaactctttatctaacagataaagccactacatctttctttcctcgcttctacaattgccaataagaattcttatgccactctgattcctgagcttattatcagtggtctgttttttgcctcctccccttcaaaaatttgaggaaaattttatctgtggtactctttactcatagtaaagtaacagttgctttgctaatcattcccttcagttccaggattttttttcattgtctctttgataatgaatagaattccttattccctctatttctttgttctagaaatcctgttataacggactgctttgtttcatcttctcattctattagctgctctctcctattttctagcttttgtcattttgccttctattgtgatagacttcctcaactttgtccccaatctttttgtagaattaaaaatttttgttaacatattttaatttttcacagtcttgttcttgtattttgactgctttttaaaataatattctggttttgttcatagatgcaaaattttactcatcttcttttagggtattaattatgcttttcaaagagtgttaatttgcttcctgcattgtcttggcttccttgttcctctttgttttggaatctgattcaatgtgagaatctttctcaaatgtttagtattcttggctggtttcatatttaatcgtgaggcctaacaaaatgatgggaacctatgtgtccaaggaagcttccttttggtgttaggtgggaccctgctcttccactgggggtcctccaatgtcagtaactgaatcttttccctgacatatgccagtttaaccagggaggaaattgctcgtttctcctctggacagtaaatgcctgatgcatcaactcagagcgtttagagggggctggaggtctcaaggctcagtatgtggactctcatttaattttaattctctgcatttcagtacagtgcctcagtgtgactggtagtatctctgaacttggagttgttctggttcaggtttctgttgtttttatttgtttgttttctatagacaaaagccttcatctgtggtagaagaatctatgatttagttaggccttaaataacctaaacgttctttttgctttcagtccttcttcttgtccctgtattcagggatacctgctgcctcccattctggagactatgagcttccatagtgaaaaacagctcaattcttgccttttctttctgtaggcagtcagctttcatctctcttggctctgctaaattaccactcctccatctgctttccctcttccagaatgctttgtctgccatgtcagttctcatgacagttgatttgcccttgtgaaattatgaaaattttcactatactgccatgttagtaaggtttggggagagagtggaactaaaaatgcgcacattcaatccctcatcttaaacaataaattttatttgtagatttgtcttgttttgtggtggggctgggggtatgaaaagtgaagagaggatgaaaaaggatggactgaaaaaaaaagtggatctactttttccagatcgttttgagtcacccaggatcctaatgcttataaagattggttctcacatgcacttcagctgttccgcagcctttcctggtggttgccaaaaacagcttccagggcttcgtctccttcgctgcaaccatagagacatcgttaggtgctgaaggcagaatgaaggcctgaggcctatgggagccatcacaaatgctactctccctcctgctgacttcttttgaggccagcctctccccacatggagtgctcagaggcactatctcagaagaaccagcagaggcctttttctctttctccctgcattcaaggactattttattgggttgaatgcctaagaattgactgcagctaggcccggaaagcttagtctagtcctttgttctgaggactcagtttctttatctacaaaatggaatattgaatcaaaagcttcctaagtctccttttaacttttttttttttttggacagagtctttctctgtggcccaggttgaagtgcagtggcgtgatcttggctcactgcaacctctgcctcccaggttcaagtaattctcttgcctcagcctcctgagtagttgggactacagacatatgccaccatacccagctaatttttgtatattttttgtagtagagacaaaatttcaccatgttggtcaggctggtctcgaactcctgatgacctcaagtaatctgcctgccttggcctcccacagtcctgggattacaggcatgagataccacacctagccttaacttttgttaaaaggattgtattaagatagaaaaaagcgaaacaaacaaacaaaaaactgtcaaagtaatacaaatatgtagtaaatgtgctgccttccagataacattaaattcaccaaatttttcctgggtgtttgctatacaacggtgaaggatgtagttcttgcactcaaggaacttgctacatggtaggttgtaagtctacagacacaagtctacagatacctaaataatccacttaaagtaggaagtaggtggactcattagagtgcagtggagaatatactgcagaagcccagaggaaggagtgatttccaactgaggaaacctgagagggcttcatggaagaggtcttctgattcagacacaaccaaagcaggaggtagaacagtagctgaactatactttcccactgagttatgaaaggctttgactagggatagattgagatcaaagtttaatctatctgaagggtttaacaagagatgacaggtggtagtccagagtagcatctagagtcaaggaaacccaacatgcagtgatgaggtatcccaacaggttgatacatgggatatcagaaagagagaatagtcagagatccaagcaggcaggcagcattatgaaaatctgtcagcagggaacagggcactagccaccagactgaaattagggagtaggatcctaggcctagagaaagtcttcacaggtagagtaggttttgtcaagagcagagcagggttccatgtacacaggaaccagtgaaccattcaagacatccagcagggactcagatacgggccatgataatagggttggaggatattgatttgggagtaaggtcatagcctagttattagccctaggtgtggctgagcagaaccatggcaatagtgagccccagaacatcaggattattcctagtttgggagcaagagataaacgtgtcaggggaggtagggagaacaccacttaagagcatttgtttttaaggaattgagggacttggaggtttggaatcatttgagatactcagctaaggctgtccatggaaatcaagaaacaggagcacattccaggagaaaaaatgatagcaggaataaagaagagaggctgagaaatgcagagtaggtataaggaactgcaatcggaccagtgtaacggaagcacagattgagagaggagaaacagtaggaaattaatagacttgtagaaaggctggtgcagcctgggggtgctgtggaggctgtgctcaggaattcataatggactctacaggaagggggtcacaacaaatcaagctaatgaaaaagcacaggaggctggagacaagggaaatttttgaatgcatcaaattagggatgacaaaagcttgaaccagggtaattgcaggacaatggaaagggacagacaatgtaatatagcttcagggcaggaactttgaattttcccagtatggtactaataaaaacttcaactggcttcttttcatgtagaaatcattgcaaccagtacaggctcaagtgtatgtttgtactcactctcttagatgagaggagtaatttgaaactttgaaatagggtattgctaacaatttgcatggggctcgtatgagaaacaagcccattatcatgactggcaagacagagtgccattgggtcaataattaaaccagctagcacttaaatgatcattttgactacttatgagagcagcaactgtttattaagtgcctgttatcgaccagccatatatgtaacttacttgaattttgcaaggtcagtattattgcccattttacacatgagaaatttgcttagtgagttaagtaacttaagcaagttcacacaactagtaagtagcagaactaggtttcacatctcgatctgtctgacctgacacctggaggtctttccaataaagattccatattgcctctacttactaaacatagctgtcattttttatgtatatttgcgtaggaaacatataaatttgttttcctctttgtttgaattcttataatcataactaaaaatccctttaaaacatcagatacatacatgcatatgcatatacatgtatccacttatattcacacatatatgtatatatttcatgcaaactagataactacctgtaatttttctttcatttcttacagttttatggtcctttactcaccttggttgaccttgtagacctgtgtgtagatatttcaaaaggctgtgtctacttggaacggatgcatttcattcacaggtacaattctcttctggatacagggttattacggatattggcacaataatcacctgtagtgcaggtaaagcacacaagataattaaacattttaattccttcaaactagcaataatttctattaaaagtctctcttataaatcattctactgtaaagacacatgcacatgtatgtttattgcatcactattttcaatagcaaagacttggaaccaacgcaaatgcccatcgatgatagactgggtaaagaaaatgtggcacatatacaccatgaaatactatgcagccataaaaaagaatgagttcatgtcctttgagggaacatggatgaagctggaaaccattatcctcagcaaactaacacaggaacagaaaaccaaagcaggttctcactcataagtgggagttgaacaatgagaacacatggacacagggaggggaacatcatacaccagggcctgtctggggttgggggcaagggaagggagagcattaggagaaatacctaatgcaggcagggcttaaaatctagatgacaggttgataggtgcagcaaaccaccatggcacatgtatacctatgtaacaaacttcatgttcagcacatgtaatccagaacttaaagtaaaaaaaaaaaaaatagtttctcttctttacagacctactagggctacttctttgatttctggaactttattgttgttattattattattattaaatataacttctgccacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtaagtttaacgggacacagagtaatgctgacagaatcatcaaacattagaggggattttaaaaggacatctaatcttgcttttttaatgtgagaaaacagaagaccagagagattaagtgatttgcctcaagctaaagtgagagttggtggtcaaggtggtactattcctgggtctcagcagtttatgctcctccctgaatcagttttgttatgaaatagatacatttcattcaaatattttattacattccaaagatgtaaaagcctatgactaataggaattggtacttaggaattaatgtccaagtgtgtgcccaaatacctactatttgggaatgtttggtcattaatttatcagtaaactttaaatcatggatttaaaagtatcctaaaagattaggacactggggagatttggacatccctttattatttgaatgatgccccttatttttgtttgttgactccaacttttgaatagaacagctcaaaatgtaaaagtttgttcaatgacttttaagttgggctggccctaggcaaaattacgaatgagataaaatttctcagtgctgccaatttttattcatgccttccctctcaatgtttactggcactttatcccctgcaaacttgggaggaaaatgctgaaatgtttttgtgctcaccctttggtgtgtctgcatgtcaatgctctgaaattcttagataatggaggcctacagtggggattcagtcagggagagaaacagagtatgagttgtgtgtatacatgtatatatgcatgtatgtgtgtgcacgtgtttctgtgtgtgcatgcatgtgcatgtgtgtctgtttctgtgtgtgcatatgtgtatatgtgcgtggatgtgcatgcatgtgagcatgcatatgagtctgtctctgtgtgtgcacatgtgtgcctcctccaagccttcctatcacctttgaagtatttgctcatacgcagtgtcttgttctactttttcttgtcagcctgcttttatatctgccgtttgccttttatgaggccaataatacactgacaaagtagaccctgctagccccaggaaaaatgttgttggagaaactactgtaaacctggtgtttgtaataagtataattaaagcaaaccctctactattcttaggtcttttggaattctgatttgggagattttaactcttggtcatcagccttatccagctcattccaaccttgatgtgttaaactatgtgcaaacaggagggagactggagccaccaagaaattgtcctgatgatctgtaagttaattatgttaacatatgtatcccccaaacaaaaacatgtgcacatacaatcttaggcctcttgatatagtttgttaaattgttaaaataagaactggaacttaaatattgtataccccacataaaatatcaattcattgtgtcaatttgtgaatatattatggcttctttttaattgtatatacacatgatatttcactgagaaacaaaattttggagagtaaaatacttctggttaagtaaaatacttctggttaagtgaattctaataaaagcactccgagtgtatgtgtgtgtgtgtgagagagagagtatacacacacatatgccttttattttgggagatatgatttgactagtatcttaatctacatattaaaatattatactaaatgggaatatattgttaaaaagttggattccctttgttgatatagctgacattgactaataagaaatagtattactaaaaattatacaggttgtgacctgtttatgaacataacaaaaaatgactaagtattgtaactttagcgaatcctggccattattgaattccaatagtgatttctcagaagagtgagtgaattttagtcaaattataaggaaaaaggtttttattctgagtattaatctgcctccttgtggaaagtatcagcagaaatattaagtcttgacaactttttccaagaattgtcttacccaagaagttcctaaaagagcaaataagtatgaactctccatgtgcaccatagcatgccaaggattgtatggattacagaggtgtttaaaccagggacacagctcttcagcatctcagaatgtgttttgaatgaaaagacacccacagagagcagttggatgccaagccaacatgtaataaagtgctaaactgtgtggtacaggcaagtgcaaaaggaattagcagtatgcggatgcacaccatggttgtactgccttgactatgctgtgttatttagaggattattcagacttgagccaaaagatgattaagagctgggcaccttggttagatgttctactggtgaatgtttttgtattatttaaatcttccagctagaagaagattggaattaccgcttgtttctgatttaacttaatagtctctgcgatgtttacagggagatcagatacacacacatctgaccaaatttgatagtagtgcataaaaaatgattcataatcattttggggggaaatggggaaaaattatataaattaaggataagaaattatacaaaatttgaaaacctttcatgtagggtttaagaaaaaagcccaggatacctaaatacaaaataaattttaattaaatatttacaaactaatcactgttttgcatctcttacacctctgtcaaacactcagaaatttttgccagaatttcagttgcacaaaattttccttgtgctgttagaatgttatctggcttatgccactctctccccaagggttaacgtgcctcgtcacaatcatgcaatatttttggataggcagctttgaaattgatcactaaactatcagttttgactgatgtgtttgattattttgtttggggcaggggggttaataacaaattgctgtattgtggagcagaaaaaggtagacaagttgaactttgctctatctaaaggtataaaaaatgcaactagaaggaggaaggagcagtgctagaaaagtattcctgattatgagtggaaaaatataatattctatacagttttatcttgaataatttattgattggattgccattgttttaataaaaatatagtttatttgaaatgaaaattttccattggtggttttgaagttcatttgaacatcattaataaaaataagccatgcatcaagccctccaagtgctgcaggactctaacaagccctgggaagggttaaagatccgttgccaaccaggaaaacaagctgggctaggaaatggagatctcagcaataccattcaatctggccatggccttaagttgtcatgataaagattaactactctccttagagtacagagggaactgatatttatttgaagcagttttctgagatcacaggcccagcttaggggtttgaaagtctgcactgagccctgctacaccttccatttactgcttaaatactcagcacctggatgcactccaggtcaggtgagcccatagatagctatgctgtactcagctattaatggaatgccaggttcagagcattcctgcccttctctccatagcctgagatgtacgatagaaagcccagccatcaggattctcttcagtttttagtttgcacaacaaccacaccactcctgagaagaaatgggatcaaagggcaatctacttcaagtgagagctttctggggttttataacagatatatcacagtggcaactggaattactggagagtccctcaggtgtgggaggcaaccgtgggagaacacagaggttcaccatgttatttttacatcttaaaaaaatatgtacacctagatactaatcggatctctccaggattaggtataataagtaaggaaaatcttgaaggctgtattttatgtactttgtttaaatacctgtagaaacttttccctttaatactgaaaaatactatgacgttttcatgtattgaagttcaattgctttgtgaattcaaagtctttaatatgcatagaggctaacattggatatagctaatgagtcctgtgctattttgaaaaaaaaaaaaaaaaaaacttgaggagaagagttgtaaagagtttgcatggtgagtggaggaattggaacctctacttagccaaatgagatacttcaagtataatgagtatttttctggagccaaaacaaccagcccaggtaaattttaacaaacttgaaggacctgcaaatttgtttagagtaatatgtttgaatatttgtaactataacttggtgcgagtatacactgcatgatatagaatggtgacaaggacatatttgtaagggaagatcctccatgccaagactatagttttcattgttaatttacttacaagatataagaaatacatttaggattattaaaagcctcttcatttcattccattgccagtttattgctatttgagaaccgaagttttattctttacttttagatgactgttgcttatatagctcctcttttcttagtcctcatttgtccctacatggtggaacagaaagggtttatatattaacaggtcaaatgtgtttgtcatcagaaaattaagtacagagtaatgattggattaaatgtaaatttaagcctccataattgaaaaaaataggaatttctaatttctgcttaagtggattttatagattaaacaagaggctgaacttttggaggtagaatgagtgagtgatgtgcaagtggctaagtggcagctgtaaggatggtttctttttcccccaccttcctcttcccgggcctcctcttccttcttctttttctttctctccttctaaataatctcactaagtatcttgatttttttgcagaataaagcaggttataagtaagtatggcaatagcccttttttgtgggagatatgttccaaggcccccagtggatgcctgaagccaagaataatacctgtattagttcattctcacactactatcaggaactggtaacttataaagaagctgggtaatttataaagaacctgggtaatttataaagaaaagaggtttaattggctcatggttccacaggctctacaggaagcacggctcaggaggcctcaggaagcttacaatcatggcagagggtgaaggggaagcaggcacagtctttcccatggccagaacaggaggcaaagagggagcaagaggaagaaacaaggaggtgctacacttttaaacaaccagatctcataagaactcttatcaccaaagcagcaaggtggaaatctgcccccatgattcagtcacctcccaccaggcccctcctccaacactggtgatacaattctacatgagatttgggtggggacgcagggccaaatcgtatcaatacccaaccttatatacactatgttttcttgatctgacaacctagtcaactaatgggtaggtagcatatacagcatagatatgctggacaaagggatagtttcatgtctcagtttcatgtttcattacactactcagaatggcatacaatttaaaacttatgaactgttcatttctggaattttcctttaaatatttttggaccatggttaacctcaactaactgaaaccatagaaagcaaaactgataaggagggacaactgtaaaaacctcctaactgaaatatgaccaaccttgagagattctctctatgccttggcaatatttttgaatcacagctttattttcaaaaataaaatgcttcactttttcctctcaactctgaggacaactgttagattaatcatcaaaactctactttattttttaaattctgtgatctgacatcgattataatatctcatttcaaaggctaatgatccttcattgacatctttgtatcatccccatttctaaatggcacaggttatagagaactatgtaaaagattaggttgtcttttggttatttctcagatatgattctaattttaaaaaatagagccaagcttggcactgtatacccattatgtaaattgcttgtaatacatgtgaagtcatcagatcaatacattgaaacagtccaatattggttttccttgataccatttattctgatatggtgtaccaactctgacctgaggtgcttgttaggaaacgaaataaatggaagtggagtttgtatgccatattataatggaatggagattgcattataattccccaaatggatactagctattttaaatacaatacctataatgatttctgggccatcgttacctagtgattataatcttgttctagctccacaggcattacctcagtccacaccatcattatctctcatctagtcttctttaatagtttccaacctgcccctttataatttatagtccacatatctgctagaataatccttaaaaaatgtaaagattatgtccgcttaaaaatcttgaaaagcttccccttgtagtgttgtaaaatccaactccttgcctgccctgtgagacctgcatgatctcgcttccctcctctgatctcatctcatcctttcccctcaatgaccacacttcagtgacactggctttctttcaggttctaaaatgtgccaagctctttccaaatttaggactttacacatgctttccccacttgtagttccctgactcccatccacaccctattcccatgagtagtatcttattttcttacaaagttctttggcttaaatgtcacctctggagaggggccttctgtaagcaactttccaaaactgtttcatgtctattagaactcgtgtttgttttctttataactttgcaaagaacttataatttgtgattgtatatttgttcatatagtagtactaatattttaagtacctcccaatctgtttctttatcagttctctctccctgatcctgatctgccatatagctccagaaagtaaaaaatgagagcaagtacttgtttataataagtcagtaggcttgaaaaccaggcttggaatatagagagcatctacagtcctttagctccttgttaatgttttaagtactagattttaattgtctgtgtaaaaacatacaattttatataaggatagtcaaattaaaaaaggcagtgaatagagccctcattccttccaagccctggggaagtgaagaaagaagagaacttgatagaggcgggagggtgaagatactggatatctgggtttggaaacctcctctgtaggcttcaattagaagagatgggtaccaccaaagccaactgctcagtcacccctagtttgggagaattacaaagagatcattgagtggaggaccctcactttgacatgggagacccagcattgtcaagaaggtagaatgacttgtccagacagaaaggtctagcttatgcttccaaacttcctttgtttcctatattgggtgaacattttgttgagagctagagattctgccaagtagcaccctgtgggcctacagcagaaacaggaatggattccctgggccttgagagcatctacagggcttgatagcatctaagaatcctacagctagagatagacaagtttggaccactgtagtggggaagcgtcaaaagaataggtaaataattcacagattgccaataggggctgatgcctaggctggatcagataagtcactccttattgaattctggattagccactgagactatcaaagatatggagggcacagtggggttcaaaggattcttcaccatgcctctagaagtcacataagcctcgtactcaacatatatcctgacactaccttagacaggaaggcagagggagtggggatggcctgaaaataagagaggttgggttattatccagaaaagactgaatattacttaaaaagattgtttaaaatagtgggactaagttataaacaacattgtactaaatgaagtttcttttcttatgctaggtagggactctgaaaaagacctagttaattataaacaatataaaatacttacaatttttctgcttatatgagttgaggtgtgatgaattttgcctttctcttataattactatacatatcatctatgaggacaagagtcacatggccatgtccctagctcctgatatactgctggtataaaacaagtgtccaacatctttgctgagtgaatgaatgaatactacttaagagtgctgcacagatatttcttggacaaccattaaggaaaagataatgtttaattaaccagctgtgaatgtctagggaactcaacctgactataatgaacagtaaaacactggcatcaaatctgattgctgcttctagttctgtcactaaatatctgtgtggaatggagtaaatcttttaaatgtcagcctcttcaacaatttttatagctattagtttctttatgtgttgatacattatgattgactataagactgacagtgcaggtgagacctttaccttgagagcttagagagctacttgaacacccttgattaaagaatggtcctcttctatcagggaaggtcatcctctccaaccaagttttcaacttcaggagggttacgcatggaacactggaggaaagggacacctgtatagccagacatcagctgaatcaaccctggtgatcaatgggtggtagatgttgaagccagatcaccctcacaggagaccttcaccttgagtagttgagtgttgagtagatattttcccaccatctacttatccatctatttatttggaataataactgttaaaataatgtcagcttttcaaaagaaaggtgttatctaataaacgtagtaatgttaaaagccactcttaaataagaaatcaaagcctttgttttgattcacttatattaattaaggaaaactggcaataactcagattctttcctttctaaaatgaccctacctgggttatcagtaattatatccaattgctatttactttcccatctttccccatatatttaggtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtaagtttgattcttcagaattttctagttttcgctgcactgtgaactgaacaaagttaaaatggaatgtacacagaaagcattttggggtaggcaaaaagaataatatactggcacctttgtcatcataattaagtgtttattgcattcctctttgaaaattatttgtattatgcactaaattgaaaaaataaaggatagttctatggcccctggatttataatctatgacagtaaggaggagaattaacatgttagactacattttcataaggtctgttctccttctcttctccccccacacaccagtttggacctcaagtacagagttaattatagactctttgcttacggtacattatcatcattggcctatgcagggctcctgtcttgtttgtttgtttagccattttatccccatattcctctcctcttcaacttcctccctccctgtcaggcaactattctaacgtctttagtgtgtatcttttcatttgtatgttttcctgcaaaatgtgtatttttttaatgaatgaatgcatttttctttctgttttcattaagcactgtatttttaaggtctgtccatgttgctatgtatatatctaatcctttgcttctgatgagtaattttgctatgattattgtagtggatcaggtcttgctaagatctagtctgattctatgacttcagtatttggtgattaagttaataatattctgtgccgggtgcggtggctcacgcctgtaatcccagcagtttgggaggccgaggcgggcggatcatgaggtcaggagatcaagagcatcctggctaacacagtgaaaccccatctctactaaaaatacaaaaaaaatacaaaaaaaaaaaaaaaaaaaaaaaaaaagcctgtcctggtggcgggcgcctgtagttccagctactcgggaggctgaggcaggagaatggcatgaacccgggaggtggagcttgcagtgagccgagatcgtgccactgcactccagcctgggcgacagggtgagactccatctcaaaaaaaaaaaaaaaagataataatattctggaaccattctactataatggacagactaagccttttacttaaatgtaaagagacttaaaatacagtagtcacttaattcatttctaaagtcacatttactgttatgtatgcctaattggctgcagaaaaatgaatttaaaatatttctccttcagcttatctagaacttcttgttattaaaagtttgcaaggccctttgtttatttaaatgcagacgtccttgcttacaaacgaaactggcaagatggatcgcaacttagaatctcgcagaaattaggcttcttgctatttgcagtgattgactataagactggcagtgcaggagacacctttaccttgagagcttgcagagctacttgcacacctttattaaagaatggtcctttcctatcagggaaggtcatactcttcaaccaagttttcaacttgaggagggctacacgtggaacagtggagaaaggggacacccgcatagccagacatcagctgaatcaaccctggtgatcagtgggtggcagatgttgaagtgagatcaccctcacatgagaccttcaccttgagtgatgcacttgactaatagcagataaaaacaagaagcccatggacagacatctacttgtctatgcgtcttactacatattttgggtgactttggatccattatatgagcataaaactctgatcatgtaacttcttcaacacaaactgccaagcgacagattggaaagggctgcacatgccttggccatgcgtcataaccctcattagagtaaaccttgttaatagtctcacattgtttctactcactatcatcctggacagagctgattcttagaatgccaatggcagaacacttgggaattataactggcacagcaactccatccttttggggggctctctatatatatacttgcctatgtgaagatcacataggattaggcaaacatacccttaagccattctaggtactattaaggccttgtcattttctaagcatttacttaatgagacatttctctgaataaaattttgataattaaaaaaattatttcaacacttactgatctgggggcaaggcatagtgtaagcacctgtatttaatgtcttccatttgtctgctttaaagaaaaacaagaggtgagagtatttctttctcttggaagctagaatcagtttctttaattttgtttgccaagtttagtagtaaactagctttaactggtgatactgaaagttgtccttgtcataagactacatctatatccataggaaatattggtgtcaccagttcactatttaataataatgttttgctcaagccattttaatctgctccagcatggcctggttcttatttgtcataacttcacatatggaaactttagaggaacaatcatgcagagcggtttgccaatacataaaattaaatcttttgttcctaagatagaaaaacatcagtaactgggttgaattgaatatagacatatctgaaagacaggcaaaacatggttttgcttgcttggcactgaaagcacattttcttaactatatcactcctcttttttttaaaataaatttatggagtacaagattgtttagtaatgaagtcagggcttttagggtatctatcacctgaatattgtaccttgtacccattaagtaatttcttattcactctcccacacccttaccctttcaagttttcattgtctatcatttcatactctagtctatgtgtacacattgtttcaatcctactgatgagtgagaacatgtgatatttctttctgtgtttgtcttgtttcatttaagataattgcctccagtttcatccatgttgctacaaaatacatgatttcattcctttttagtggctgaatagtatttcattgtctataacacattttcattatccagtcatccatagatagatactaggttgatctcatacctttgctattatgagtagtactgtgataaacatatgagtgtaagtatgtttttgatataatgatttcttttcctttggatagatacctagtaatggaattgctggattgattgctagatcatatttttagctttttgagaaatctccatactgttttccgtaaaagttgtattaatttacattcccaccaacagcatgtaactgttcctctttgtctgcatcctcgccaacatctattatttttgactttttagtaatggccattctgactcggggaggatgatatcttattattattttaatttgcatttcgccgatgattagggattttgggcatttttccatatacctgttggtcagttgtatgtcttcttttgataaaacatctattcacatcctttgctcactttttaatgggattatttgcttgtttgttgttgttgagtgtttgaattccttgtatattctggatattagacccctgttgagtgaatactttgcaaatattttctcccattctgcagattgtctgtttattccactgattatttctttttctgcacaagctttttagcttaattaagtcacatttgtctatttttgttcatgttgcctgtgctttcagtgtctaagtcatgaattatttgcctagatcaatatccagaagagttttccttaggctttcttctagtattttcacagtttcatttattacatgtaagtctttaatccatctttgagttaatttttgtatatggtgagggtaagggtccagtttcattcttctgcatatatccaatttccccagcaccatttattgaaaggggtgtttttctccccagtatgtgttcttgttgactttgcaaaagatcagttggctataaatatgtggctttatttctggattctggattctgttccattaaactatatgtttatttttataccagtaccatactgtttgattactatagccttgtagtattattttttaaatttatttttaatttttgtgggtacatagtagatgtctatatttacagggtacatgagatgttttgatacaggcatgtaatgtgtaataatcacatcatggagaatggagtatccacccctcaagcatttatcctttgtgttacaaaccaattttttacttatagttattttaaaatgtacaattaaattattattgactatagttaccctattgtgctatcaaatatttagtcttattcattctttctcttttttgtacccaataaccatccccaactcccccaccctgtcccttactacccttcccagtttctggtaaccatccttctactctctgtctccatgggttcaatcgttttgatttttatatttcacaaagaaatgagaacatgagatatttatctttctgtgcctggcttatttcacttaacataatgatctccagttccatacatattcttggaaatgacaggatctcattctttttatagctgaatagtactccactgtactatatgcatataccacattttctttatccatttgtctatttttttttttgagacagtctcactctgtccctcagaccagaaagcaatggcatgatctcggctcactgcaacctccccctttcagtttcaagcgattcttatgcctcggcattccgagtagctgggactacaggcacgtgccaccacgcctggctaatttttgtattttttttagtagagactgggtttcaccatgttggccaggctggtctagaattcctgacctcaagtgatccgcctacctctgcctcccaaagtgctgggattacaggcgtgagcaactgagcctggcctatccatttatctacagatggacacttaggttgcttccaaatcttagctattgtaaacagtactgcaataaacataggagtgcagatatctctttgatgtactgatttcctttcttttgggcatatgtacagcagtgggattgctgaatcaaatggcagatctattttcagttgtttgaggaacctccaaactgttcttcttagtggttgtactaatttacattcccaccaacagtgtatgaggattctctttctccacatccttgctagcatttgtcttgcctgtcttttcaatgtaagccattttaacttgactgagatgatatctcaatgtagttttggtttgcatttctgtgatgatcaatgatgttgagcactttttcacatgtctgtttgccatttgtatttctttttattagaaatgtctattcaaatcttttgcccattttttgatcagactattagcttttttcctatcgagttatttgagctccctatgtattctggttattaaccccttgtcagatgggtagtttgcaaatattttcttccattctgtggattgtcccttcactttgttgattgtttcctttgctgtgaagaagctttttaaatttgatgtgatcccatttgtccatttttgctttgactgcctgtgcttgtggggtgttgctcaagaaatttttgccccaaccaatgtcctggagattttccccagtattttcttgtagtagtttcatggtttgaagtcttagatttaaatcttcaatccatttttatttgatttttgtatatgtagagagataggggtctagttttattcttctacatatggatatccagttttcacagcagcatttattgaagagactgtcttttccccagtagatgttcttggcatctttgtaaaacatgaattcactgtaggtgtgtgaatttatttctgtgttctttattctgttcttttttatgtattccattctgtatatgtacctttgatctatgtgtgagtttttatgccagcactatgctgttttggttactataggtctgtagtataatttgaatccagtaatgtgattctttgagttttgttccttttgcttaggatagctttggctattccgagtcttttgtggttctatataaattttcagatttttttctatttctgtgaagaatgtcattggtattttgatagggattgcattgaatttgtagacaactttgggcagtatggccattttaacaatattgattcttccaatccttgagcatggaatatttttccatttgtttgtgcctcctacaatttctttcatcagtgttttgtagtttcccttgtagagaattttcatctccttggttaatatattcctaggtgtttcattctttatgtggctcttgtaaatggcattgccttcttgatttaattatcagctagattatttttggtatatagaaatgcactgaatttttgtacattaattttgtatcctgaaactttactgaatttatttatcaaatctcagagtttcaatgataagagcacgctaatatccctgatgaacacagatgcaaaagttctcaacaaaatactggcaagccaaatccaagaacacatgaaaaagatagtatactatgatcaagtaagatttatccctgggatgcaaggatagttcaacatatgtgtatatgttgaagacacattttgtggaatctttaggtttttctagatataagataatattatctgtgaatgccttttatgagatgcctttttattttctttcccctgcctggttgctctggctaggacttacagtactatgttgaataagagtggtgaaaatggccatccttgtcttgttctagttattagagaaaatgttttcaactttcctccatttagtacaatgttggctatggatttgtcatatataacctctattattttgagatatgttccttccatgcctaattttttgagagcttttattatgaaagaatgctaaatcttgtcaaatgccttttctgcctctgctgatatgatcatatggtttttgtctttcagtctgttgatgtaatgtatcatgtgtcttcaacatatacacatttgttgaactatccttgcatacctgggataaatcttacttgatcatagtgtgctatctttttcatgtgctcttgggtttggcttgccagtattttgttgagaatttttgcatctgtgttcatcagggatattagcgtgctcttatcattaaaagcaacaaataaggctcaaattttttgacagataaggctcaaattctttgtgactataattttatagactttattaattaacacaatcatgaccttcttaaaagtttaaaaacaatttttatgttattttacaaccataaaaatgacttctgattcctttctatttttcttgtaacttttccagtaatctcagtaactgttcttgctgtattattttataattgtatctacattttaaagatctttattgtaaaagtaatttatgtttattataaaaaatataaaattacttaagcagtctaaaaagtaaaagtttcctaattcatccttatctcactccccagtgctagccagagctaacaatttggttatatatttgcagatattgtatgtgcatatatagccatttacagaaatgctcatttatgtatgtttgtatatatactatctggattcagatactaaatttaggtaatctaaaggaattcatgggctgtagattctgtagtaggttctccagcatttttttcttacaaataagcttatttttaaggatttggtgagaagatgattttgtattacatcttctgccagaatccaggaaatgagcattctatgttgttattgagaagaaatccatgttctgtgggagtccagaggaaggatgccaagtctacactatggcagagggagagtcaagaaaaaccattgggaggaggttacatctaagctgagacctacttagaagcttaggtatgaaaaagagaagctgaggtatcctatgtatttcaggatagaagaagcagcatgtagaaaggcagggaataatagagaatgaggtattcatagaactgcactttgtttattatacatgagaatgtggcaagtgataaaattggagggttattggtcacactaatcaaaagtaaggaatgaaaagtaatgaaagctgaattaatgaatggtaacaggtgtagagagaacaaaaaagagtccggagttaccacagaggtagatgctatcggacttggcaactaagtgcgtaaaaaagagaaaggagaaagttggtaaaaatcaacgctattcctggagatgaggaacataggaagaggaacagttttgcatatgtttggtttgagttggcttggcatatctaagcggagaagtccaggacacagtcaagatatgggttcatactcagttgaaaggtctgtcctgtaaatatagatggttgaagtccagggtgcagactaggtcattaaagtagagtgtatgaaataagaagagagtgacaagtgggtggaacccagagagcagccggtataggaggggcttacaaagatggtggacatggggaggagcagccagaaagggaagaggaaagccatagggagtgttgttatggaaatccagaggagagaggcttagaaaggaaagagtgaacaaatgctgcagagaggtaaagcaatccagagggttgcacagattttgcagttgacttgtattctaaaattcaactctttgctcatggaatcctttccttctaatgtgcaaagatacattataaaagtcacagagggccaggcgctgtggctcatacctgtaatcccagcactttgggaggccaaggcgggcagatcacaaggtcagaagatcgagaccatcctggctaacatggtgaaaccgcgtctctactaaaaaatagaaaaaattagctgggcatggtggtgggcgcctgtattcccaactactagagaggctgaggtaggagaatggcgtgaacctgggaggcagagcttgcagtgagccgagatcgcaccactgcactccagcctgggcgacagagtgagactccatctcaaaaaaaaaagaaatgaaaagaaaaaaaaaatgtcacagaggttgccataatgggtgttagcaggcctgagagcttagcttcaccttaggttctacttgaagtctccacggacccttgagaaaatcttttcaccattttgcattgcatagttcatctatgaggcagagataggtaagaaacaatgctcacactcaatataaagagtaaaatacctctgtgaaaggcttttaattagaatagtagctaattttattttagtacttttccatgtgccactcactgtgctatgtaggttaactcattaaatctttataacagccttatgaagcggatattactatatcaccattttacagatgagaaaactgaggtttagtgacttgctcataatcatactgctgaaatagggctagagtttgtctccattgttgagcctttcctctcagccttcacaaatccctggctgtagtagggaaatggcccaaacaatatccccagttatgttaccaatagtgtactgcacagctaggtataatgaaagcaatgattacttatgacctgctagaaaatatacaccatttttttctggttataccaaatctatttaggtaccaagttgttggcagaaagaattaaaattctaagtaatattcccaacaatagagaagcagacaaatattcaaagtaatgatgcaggaagaatttaacagggaatatcatcaaactataacaatttagaaagaaacaagcatttctgggccatgacagaaataaaattttaggaaaagagaaattgctgttctgttatttacaatgaatgtaaatcctgaagataaggaatgaaaagagatgtggaaatcactaaattgataattgagtttgtgactgagcaagaaaggcagggaagagagaaaaaactgaattaaaggcggagtttgcatatctgcaaaggatagaaatagtgcaacagacctttcaaggcaaacctaaacttaattattttttcaataaaaaataatgtgtttaataatagcttactgctttgcagactggtgggcatatttagcaaagcaataaaatgactgtcttcattgttgttgttggagatatgtacgtagagaagaaaagctattgaaaggactttttaaagcaaagaagtgggggtgcttagaaaaacagggagcaataataccatgcctatcctgtggtcctactgacctaatggggtggaaaggggatagagagagaagattagtaacatatctgggcatctagtaaaaatatcccagtgacttcatccaaacatttgtgtaaacatcacctcatcagtcccagagagttctacaggaaacaaatctaaatgctcctctgctgttctaaacatagccagtcagccggcatatgtctagtctgtaaataccccgtcttacttggaagtctttattttaatatttctctcttaaagaggttgcccagtgcatgctatctttgttgaggatatctgccttaagatctgacccatagactacttattaaataatttttaaacaaaagcaaacaaataagacaacctatctctactatcgcagtctcttgtaagctctttttgcaacaagaagatgtactaattgctgaaagcttgccagggtcaagttactaaatattgctacaagtactataaaccaataaagtagttagctaatgatttttctttgacacataacaacagaatttgcaaaaagaatttatttgcctcatataaaatattatttttcagaaaattcaataagcaaaaaagtttaaaaaattaaaatcatgttttagtaggaagttttccaatatgctcattcatggattaaatgtatgacaatgaaatagctgatatgagtgggtagactatattgtagatttaagtttttgttgaaattctaaactttcctttagactgatttctttaagcctattaagaacatcctaatttccccaattattggattactgtactacttaaagttaaatatcttattttttcctaacatttaaaaatattttccattgctattattacatataccaagttattcttatgggcatcttaatgactattagtgcatattggcaataatcataacagttgaataccttccacaggtgttgaataccttccacaggtgttcaacacccaggtactaaccaaacttggcatctgatgaagttctttctattagggagataattttacaacacatctaactattcatgtgttttgaaatatgctataatgatgtttgaacaatgaagaggaaaattagatgataccaaagagcctgtgaacctgtagcttggctatcttgttcttcagcagttcggagggtctgcaaaaaggagatgcatacctaatgatatggggagaagggatgtagttcatacgttcttataaaataagctttgtagttcaggtgttaaacttaataaataggtagatccattaaatttttattgggaaaaataggtacactggtacctcccttagtcttttgaaattatggtattttcctcatatttcaattgaagttcattaaaaataaatcaaacctggatgtgtgtcagggctgaatgtagaaatgtttttcattcattgctatatccatcaataactagaacacaggcttggaatgtagtagtcatcagtaaatattacattaagcaattaatttagcaaaattactaaatctagaaaaaccaatctttaaaattagatatttcagttgctgtggaagtataaaaaagtacatactttagacaaaaagggccctctaagggccaattaagtcctatcacaaagaccacgacttgctccgcttgttaaggcagagttaatcacccctgtgctcctactacatttaaaaatattcctttattaaagtgcatgtcaccttctataggtgacatatatatacatatagcagatctatatggtctgcttccctgctagactgcagcagcctcaaggacaagaagcatgttttatttgtctttgtattcccaacacttagtagtcttcataaatgtttgctgaacaaatgtgtaaagttggtgttgctataattctgatatagcttgtatattattacaaataaataattaaatacatgctagaataacattcatatttttttcacaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaatagcgttgtttgggaaatagagagttgagataaacactctcattcagtagttactgaaagaaaactctgctagaatgataaatgtcatggtggtctataactccaaataaacaatgcaacgttcc

SEQ ID NO: 6 - DNA, 30 bp, artificial sequence
  ALK primer
acgttggatgtcctgccttcctgccccctt

SEQ ID NO: 7 - DNA, 29 bp, artificial sequence
  ALK primer
acgttggatgcataacgaagtgacacctt

SEQ ID NO: 8 - DNA, 29 bp, artificial sequence
  ALK primer
acgttggatggcttggcctgggctgccct

SEQ ID NO: 9 - DNA, 29 bp, artificial sequence
  ALK primer
acgttggatgagggaactgcagctgctct

SEQ ID NO: 10 - DNA, 29 bp, artificial sequence
  ALK primer
acgttggatgtcagccaggaggatacaca

SEQ ID NO: 11 - DNA, 29 bp, artificial sequence
  ALK primer
acgttggatggcgagctttcaccatcgtg

SEQ ID NO: 12 - DNA, 28 bp, artificial sequence
  ALK primer
acgttggatgctgcgccggtggaagcat

SEQ ID NO: 13 - DNA, 29 bp, artificial sequence
  ALK primer
acgttggatgttggggaagagtgggctag

SEQ ID NO: 14 - DNA, 29 bp, artificial sequence
  ALK primer
acgttggatgcagaaaccgattttcctat

SEQ ID NO: 15 - DNA, 29 bp, artificial sequence
  ALK primer
acgttggatgtgacctgcaggtcagctca

SEQ ID NO: 16 - DNA, 30 bp, artificial sequence
  ALK primer
acgttggatgatgtctctgccagcagtaag

SEQ ID NO: 17 - DNA, 29 bp, artificial sequence
  ALK primer
acgttggatgcaagagcctttccctctgc

SEQ ID NO: 18 - DNA, 29 bp, artificial sequence
  ALK primer
acgttggatgttctaccggcagatccctt

SEQ ID NO: 19 - DNA, 28 bp, artificial sequence
  ALK primer
acgttggatgcctttgagggatggcacc

SEQ ID NO: 20 - DNA, 29 bp, artificial sequence
  ALK primer
acgttggatggccgagcacgtagtaacca

SEQ ID NO: 21 - DNA, 29 bp, artificial sequence
  ALK primer
acgttggatgtgatcagattagggttacc

SEQ ID NO: 22 - DNA, 29 bp, artificial sequence
  ALK primer
acgttggatggagtcacccgctatgtgct

SEQ ID NO: 23 - DNA, 29 bp, artificial sequence
  ALK primer
acgttggatgtagattctgtgtgtaaagc

SEQ ID NO: 24 - DNA, 29 bp, artificial sequence
  ALK primer
acgttggatgtctggaaggcaaactccat

SEQ ID NO: 25 - DNA, 29 bp, artificial sequence
  ALK primer
acgttggatgagagctctaccaatgtgag

SEQ ID NO: 26 - DNA, 30 bp, artificial sequence
  ALK primer
acgttggatggtcaatgaaatgaattcacc

SEQ ID NO: 27 - DNA, 29 bp, artificial sequence
  ALK primer
acgttggatggtaactcctgccctgtttc

SEQ ID NO: 28 - DNA, 30 bp, artificial sequence
  ALK primer
acgttggatggtcacaggacctctttggac

SEQ ID NO: 29 - DNA, 29 bp, artificial sequence
  ALK primer
acgttggatgtgtgctctaattccgcctc

SEQ ID NO: 30 - DNA, 29 bp, artificial sequence
  ALK primer
acgttggatgtggagaagagccacatcat

SEQ ID NO: 31 - DNA, 30 bp, artificial sequence
  ALK primer
acgttggatgtcttggtcagttgtgtttcc

SEQ ID NO: 32 - DNA, 29 bp, artificial sequence
  ALK primer
acgttggatgagggcagcttcagtgcaat

SEQ ID NO: 33 - DNA, 28 bp, artificial sequence
  ALK primer
acgttggatgtcccaggaattggcctgc

SEQ ID NO: 34 - DNA, 29 bp, artificial sequence
  ALK primer
acgttggatggccctaaggggttctggag

SEQ ID NO: 35 - DNA, 28 bp, artificial sequence
  ALK primer
acgttggatgttgggtggaagcaccctg

SEQ ID NO: 36 - DNA, 29 bp, artificial sequence
  ALK primer
acgttggatgcagactgtgttgcaagtat

SEQ ID NO: 37 - DNA, 28 bp, artificial sequence
  ALK primer
acgttggatgtgcccatgagaggaaatg

SEQ ID NO: 38 - DNA, 29 bp, artificial sequence
  ALK primer
acgttggatgctggagatgggattagacc

SEQ ID NO: 39 - DNA, 29 bp, artificial sequence
  ALK primer
acgttggatgtgtattatatagggcagag

SEQ ID NO: 40 - DNA, 30 bp, artificial sequence
  ALK primer
acgttggatgatttaaagtaaatgcaaagc

SEQ ID NO: 41 - DNA, 32 bp, artificial sequence
  ALK primer
acgttggatgaatactaataaaatgattaaag

SEQ ID NO: 42 - DNA, 29 bp, artificial sequence
  ALK primer
acgttggatgccctggatctccatatcct

SEQ ID NO: 43 - DNA, 29 bp, artificial sequence
  ALK primer
acgttggatgtcagctgcaacatggcctg

SEQ ID NO: 44 - DNA, 30 bp, artificial sequence
  ALK primer
acgttggatgctgcaagccatgcagatcta

SEQ ID NO: 45 - DNA, 29 bp, artificial sequence
  ALK primer
acgttggatgcagggcgctcaccgaatga

SEQ ID NO: 46 - DNA, 30 bp, artificial sequence
  ALK/ELM4 v1 primer
acgttggatgaactactgtagagcccacac

SEQ ID NO: 47 - DNA, 30 bp, artificial sequence
  ALK/ELM4 v1 primer
acgttggatgacaatatgagcaagtcacca

SEQ ID NO: 48 - DNA, 31 bp, artificial sequence
  ALK/ELM4 v1 primer
acgttggatggttaataattagaaagaaatg

SEQ ID NO: 49 - DNA, 30 bp, artificial sequence
  ALK/ELM4 v1 primer
acgttggatggataaaatggaagagtggag

SEQ ID NO: 50 - DNA, 30 bp, artificial sequence
  ALK/ELM4 v1 primer
acgttggatgccaaccttagtgtaggggtc

SEQ ID NO: 51 - DNA, 30 bp, artificial sequence
  ALK/ELM4 v1 primer
acgttggatgtatacaggtcctctttgccc

SEQ ID NO: 52 - DNA, 31 bp, artificial sequence
  ALK/ELM4 v1 primer
acgttggatgctttgaaaaaaatgtccagag

SEQ ID NO: 53 - DNA, 30 bp, artificial sequence
  ALK/ELM4 v1 primer
acgttggatggagagattcttagcagcaac

SEQ ID NO: 54 - DNA, 30 bp, artificial sequence
  ALK/ELM4 v1 primer
acgttggatgaatggggaaatcaccctgag

SEQ ID NO: 55 - DNA, 30 bp, artificial sequence
  ALK/ELM4 v1 primer
acgttggatgtcccctaaacacactggaac

SEQ ID NO: 56 - DNA, 30 bp, artificial sequence
  ALK/ELM4 v1 primer
acgttggatgttcgtgtgctcagaaagacc

SEQ ID NO: 57 - DNA, 30 bp, artificial sequence
  ALK/ELM4 v1 primer
acgttggatgctatttgtcaaacattaagg

SEQ ID NO: 58 - DNA, 29 bp, artificial sequence
  ALK/ELM4 v1 primer
acgttggatgtgtggaatttaaatttcgc

SEQ ID NO: 59 - DNA, 30 bp, artificial sequence
  ALK/ELM4 v1 primer
acgttggatgctggatggcattatatcccg

SEQ ID NO: 60 - DNA, 31 bp, artificial sequence
  ALK/ELM4 v1 primer
acgttggatgaattaaatgtttttcaaatcc

SEQ ID NO: 61 - DNA, 30 bp, artificial sequence
  ALK/ELM4 v1 primer
acgttggatgctcctatctcaatcattggc

SEQ ID NO: 62 - DNA, 29 bp, artificial sequence
  ALK/ELM4 v1 primer
acgttggatggggttcttaaaaaatagag

SEQ ID NO: 63 - DNA, 30 bp, artificial sequence
  ALK/ELM4 v1 primer
acgttggatgatcagaaatgccaggaacag

SEQ ID NO: 64 - DNA, 29 bp, artificial sequence
  ALK/ELM4 v1 primer
acgttggatgcccttttgttagccttaat

SEQ ID NO: 65 - DNA, 29 bp, artificial sequence
  ALK/ELM4 v1 primer
acgttggatgcctctctacatatgcacaa

SEQ ID NO: 66 - DNA, 30 bp, artificial sequence
  ALK/ELM4 v1 primer
acgttggatggggcaaagttgctaagaatt

SEQ ID NO: 67 - DNA, 31 bp, artificial sequence
  ALK/ELM4 v1 primer
acgttggatgcattttttaattctggccccc

SEQ ID NO: 68 - DNA, 30 bp, artificial sequence
  ALK/ELM4 v1 primer
acgttggatggtactgtgacatcctgtctg

SEQ ID NO: 69 - DNA, 30 bp, artificial sequence
  ALK/ELM4 v1 primer
acgttggatgtaggagacaaaccaaaactg

SEQ ID NO: 70 - DNA, 31 bp, artificial sequence
  ALK/ELM4 v1 primer
acgttggatggttttctgtttcttaagtagg

SEQ ID NO: 71 - DNA, 30 bp, artificial sequence
  ALK/ELM4 v1 primer
acgttggatgaagtgggtaagtggaagttg

SEQ ID NO: 72 - DNA, 30 bp, artificial sequence
  ALK/ELM4 v1 primer
acgttggatgtctccgaataatcaaatggg

SEQ ID NO: 73 - DNA, 31 bp, artificial sequence
  ALK/ELM4 v1 primer
acgttggatgcaaacatctttatttggcagg

SEQ ID NO: 74 - DNA, 30 bp, artificial sequence
  ALK/ELM4 v1 primer
acgttggatggatggacttgaccatatgag

SEQ ID NO: 75 - DNA, 30 bp, artificial sequence
  ALK/ELM4 v1 primer
acgttggatgcaaacattatttggcaactg

SEQ ID NO: 76 - DNA, 31 bp, artificial sequence
  ALK/ELM4 v1 primer
acgttggatggtttaaattagaaacactaaa

SEQ ID NO: 77 - DNA, 30 bp, artificial sequence
  ALK/ELM4 v1 primer
acgttggatggagtatttttatttctgatg

SEQ ID NO: 78 - DNA, 30 bp, artificial sequence
  ALK/ELM4 v1 primer
acgttggatgtagaaatacggaaagcagac

SEQ ID NO: 79 - DNA, 30 bp, artificial sequence
  ALK/ELM4 v1 primer
acgttggatgcttacatgataccttcaggc

SEQ ID NO: 80 - DNA, 29 bp, artificial sequence
  ALK/ELM4 v1 primer
acgttggatggtactctcagaaaattctc

SEQ ID NO: 81 - DNA, 26 bp, artificial sequence
  ALK/ELM4 v1 primer
gttggatggtgaacacagttgtgttg

SEQ ID NO: 82 - DNA, 30 bp, artificial sequence
  ALK/ELM4 v1 primer
acgttggatggctgaattgggcaagttctc

SEQ ID NO: 83 - DNA, 30 bp, artificial sequence
  ALK/ELM4 v1 primer
acgttggatggcatactcaaactgagacat

SEQ ID NO: 84 - DNA, 31 bp, artificial sequence
  ALK/ELM4 v1 primer
acgttggatggatgagtaaaaaagaacaatc

SEQ ID NO: 85 - DNA, 30 bp, artificial sequence
  ALK/ELM4 v1 primer
acgttggatgagccatcaccactatctgac

SEQ ID NO: 86 - DNA, 30 bp, artificial sequence
  ALK/ELM4 v1 primer
acgttggatgctaggtaaccaccaatttcc

SEQ ID NO: 87 - DNA, 30 bp, artificial sequence
  ALK/ELM4 v1 primer
acgttggatggacttgcttctttcacttag

SEQ ID NO: 88 - DNA, 30 bp, artificial sequence
  ALK/ELM4 v1 primer
acgttggatgatttcggctcactgaacctc

SEQ ID NO: 89 - DNA, 30 bp, artificial sequence
  ALK/ELM4 v1 primer
acgttggatgtgtgtttttagtagagaggg

SEQ ID NO: 90 - DNA, 30 bp, artificial sequence
  ALK/ELM4 v1 primer
acgttggatgattacaggtgtgagccacag

SEQ ID NO: 91 - DNA, 30 bp, artificial sequence
  ALK/ELM4 v1 primer
acgttggatgggctgagtaatatcacattg

SEQ ID NO: 92 - DNA, 30 bp, artificial sequence
  ALK/ELM4 v1 primer
acgttggatgttcaagaggactaagggctg

SEQ ID NO: 93 - DNA, 31 bp, artificial sequence
  ALK/ELM4 v1 primer
acgttggatgggacatcatcttccaaaaagc

SEQ ID NO: 94 - DNA, 29 bp, artificial sequence
  ALK/ELM4 v1 primer
acgttggatgaggtatgagtactatcatc

SEQ ID NO: 95 - DNA, 30 bp, artificial sequence
  ALK/ELM4 v1 primer
acgttggatggggtacttaacaaagtgtgc

SEQ ID NO: 96 - DNA, 29 bp, artificial sequence
  ALK/ELM4 v1 primer
acgttggatgtactgaaattattctctgc

SEQ ID NO: 97 - DNA, 30 bp, artificial sequence
  ALK/ELM4 v1 primer
acgttggatgaatccttggcacagcagaag

SEQ ID NO: 98 - DNA, 30 bp, artificial sequence
  ALK/ELM4 v1 primer
acgttggatggttaaaggaacatcaaggtg

SEQ ID NO: 99 - DNA, 30 bp, artificial sequence
  ALK/ELM4 v1 primer
acgttggatgctaagctgctcctgtacctc

SEQ ID NO: 100 - DNA, 29 bp, artificial sequence
  ALK/ELM4 v1 primer
acgttggatgtatcccctttcgtctgtgg

SEQ ID NO: 101 - DNA, 30 bp, artificial sequence
  ALK/ELM4 v1 primer
acgttggatgcaaaagattgtattataccc

SEQ ID NO: 102 - DNA, 31 bp, artificial sequence
  ALK/ELM4 v1 primer
acgttggatggttctactgaagttttcttcc

SEQ ID NO: 103 - DNA, 30 bp, artificial sequence
  ALK/ELM4 v2 primer
acgttggatggtctaactcgggagactatg

SEQ ID NO: 104 - DNA, 30 bp, artificial sequence
  ALK/ELM4 v2 primer
acgttggatgcctctttaacctgacaaagc

SEQ ID NO: 105 - DNA, 29 bp, artificial sequence
  ALK/ELM4 v2 primer
acgttggatgtgtagaacagaaggcacat

SEQ ID NO: 106 - DNA, 30 bp, artificial sequence
  ALK/ELM4 v2 primer
acgttggatggaatatgatagatgggcatt

SEQ ID NO: 107 - DNA, 29 bp, artificial sequence
  ALK/ELM4 v2 primer
acgttggatggtgtcttaatgtttttcag

SEQ ID NO: 108 - DNA, 31 bp, artificial sequence
  ALK/ELM4 v2 primer
acgttggatggcactatgattatacttcctg

SEQ ID NO: 109 - DNA, 29 bp, artificial sequence
  ALK/ELM4 v3 primer
acgttggatgaaagatgtcatcatcaacc

SEQ ID NO: 110 - DNA, 31 bp, artificial sequence
  ALK/ELM4 v3 primer
acgttggatggcgttactgtagtcatttagg

SEQ ID NO: 111 - DNA, 30 bp, artificial sequence
  ALK/ELM4 v3 primer
acgttggatggcagttggttgccttctaag

SEQ ID NO: 112 - DNA, 30 bp, artificial sequence
  ALK/ELM4 v3 primer
acgttggatgtttgagctagatgaatccag

SEQ ID NO: 113 - DNA, 30 bp, artificial sequence
  ALK/ELM4 v3 primer
acgttggatgttactgcaatctccacctcc

SEQ ID NO: 114 - DNA, 30 bp, artificial sequence
  ALK/ELM4 v3 primer
acgttggatgctaatttttggtgttttttg

SEQ ID NO: 115 - DNA, 30 bp, artificial sequence
  ALK/ELM4 v3 primer
acgttggatgtcccaaagtgcagggattac

SEQ ID NO: 116 - DNA, 30 bp, artificial sequence
  ALK/ELM4 v3 primer
acgttggatgtcaaactcctgacctcaagc

SEQ ID NO: 117 - DNA, 30 bp, artificial sequence
  ALK/ELM4 v3 primer
acgttggatgtatttctaagaaatctgaag

SEQ ID NO: 118 - DNA, 31 bp, artificial sequence
  ALK/ELM4 v3 primer
acgttggatgcccttaaaaaaaagttttacc

SEQ ID NO: 119 - DNA, 30 bp, artificial sequence
  ALK/ELM4 v3 primer
acgttggatgatgatgagtctagcaaatcc

SEQ ID NO: 120 - DNA, 30 bp, artificial sequence
  ALK/ELM4 v3 primer
acgttggatgaagagagcagacttttggcg

SEQ ID NO: 121 - DNA, 30 bp, artificial sequence
  ALK/ELM4 v3 primer
acgttggatggaagcatgctgttcttaatg

SEQ ID NO: 122 - DNA, 30 bp, artificial sequence
  ALK/ELM4 v3 primer
acgttggatgcagctgcaacgtggttaaag

SEQ ID NO: 123 - DNA, 29 bp, artificial sequence
  ALK/ELM4 v3 primer
acgttggatgatagtctttaggtcatttg

SEQ ID NO: 124 - DNA, 31 bp, artificial sequence
  ALK/ELM4 v3 primer
acgttggatgctcccttctttataatacaac

SEQ ID NO: 125 - DNA, 30 bp, artificial sequence
  ALK/ELM4 v3 primer
acgttggatgtttaagagagagggtcttgc

SEQ ID NO: 126 - DNA, 30 bp, artificial sequence
  ALK/ELM4 v3 primer
acgttggatgaagtagctgggactacaggc

SEQ ID NO: 127 - DNA, 30 bp, artificial sequence
  ALK/ELM4 v3 primer
acgttggatgaggttggtctcaaactcctg

SEQ ID NO: 128 - DNA, 30 bp, artificial sequence
  ALK/ELM4 v3 primer
acgttggatgtaggaagagcagtgaatggg

SEQ ID NO: 129 - DNA, 30 bp, artificial sequence
  ALK/ELM4 v3 primer
acgttggatggctgaatgacaatgtctctg

SEQ ID NO: 130 - DNA, 30 bp, artificial sequence
  ALK/ELM4 v3 primer
acgttggatgataaattgaaatatagtggc

SEQ ID NO: 131 - DNA, 30 bp, artificial sequence
  ALK/ELM4 v3 primer
acgttggatgggacaattgcatttgagttg

SEQ ID NO: 132 - DNA, 30 bp, artificial sequence
  ALK/ELM4 v3 primer
acgttggatgccagagagtggttttaccat

SEQ ID NO: 133 - DNA, 30 bp, artificial sequence
  ALK/ELM4 v3 primer
acgttggatgaagccattaaagggttactg

SEQ ID NO: 134 - DNA, 30 bp, artificial sequence
  ALK/ELM4 v3 primer
acgttggatgcagtaaaaccttgcactcag

SEQ ID NO: 135 - DNA, 30 bp, artificial sequence
  ALK/ELM4 v3 primer
acgttggatggcatggcatattcacaacac

SEQ ID NO: 136 - DNA, 30 bp, artificial sequence
  ALK/ELM4 v3 primer
acgttggatgttgacaatgatagctgtggc

SEQ ID NO: 137 - DNA, 30 bp, artificial sequence
  ALK/ELM4 v3 primer
acgttggatgttacctgaaaggcctgtgtc

SEQ ID NO: 138 - DNA, 30 bp, artificial sequence
  ALK/ELM4 v3 primer
acgttggatgggaaactggttgttgaaagc

SEQ ID NO: 139 - DNA, 30 bp, artificial sequence
  ALK/ELM4 v3 primer
acgttggatgggctcttactgacctatatg

SEQ ID NO: 140 - DNA, 30 bp, artificial sequence
  ALK/ELM4 v3 primer
acgttggatgagcagagataaagtcctagc

SEQ ID NO: 141 - DNA, 30 bp, artificial sequence
  ALK/ELM4 v3 primer
acgttggatgttcactttggtgagttactg

SEQ ID NO: 142 - DNA, 29 bp, artificial sequence
  ALK/ELM4 v3 primer
acgttggatgtaaacaaaatgatactgcc

SEQ ID NO: 143 - DNA, 30 bp, artificial sequence
  ALK/ELM4 v3 primer
acgttggatggattcaaccgacctgcattc

SEQ ID NO: 144 - DNA, 31 bp, artificial sequence
  ALK/ELM4 v3 primer
acgttggatgcaactaataagtaatctaaag

SEQ ID NO: 145 - DNA, 30 bp, artificial sequence
  ALK/ELM4 v3 primer
acgttggatgcagattttgctctctgcagg

SEQ ID NO: 146 - DNA, 30 bp, artificial sequence
  ALK/ELM4 v3 primer
acgttggatgatttagagacagggtctcac

SEQ ID NO: 147 - DNA, 30 bp, artificial sequence
  ALK/ELM4 v3 primer
acgttggatgctgagactacaggcacatac

SEQ ID NO: 148 - DNA, 30 bp, artificial sequence
  ALK/ELM4 v3 primer
acgttggatgcttttagcctcaagcagtcc

SEQ ID NO: 149 - DNA, 29 bp, artificial sequence
  ALK/ELM4 v3 primer
acgttggatggagatggaaaataagtgtc

SEQ ID NO: 150 - DNA, 30 bp, artificial sequence
  ALK/ELM4 v3 primer
acgttggatgagaacttcaaactaggcctg

SEQ ID NO: 151 - DNA, 30 bp, artificial sequence
  ALK/ELM4 v3 primer
acgttggatggaggaaaaaggaagtcatca

SEQ ID NO: 152 - DNA, 30 bp, artificial sequence
  ALK/ELM4 v3 primer
acgttggatgcagtacagtgatatcctaac

SEQ ID NO: 153 - DNA, 30 bp, artificial sequence
  ALK/ELM4 v3 primer
acgttggatgctgtccaaaaatggcttcag

SEQ ID NO: 154 - DNA, 31 bp, artificial sequence
  ALK/ELM4 v3 primer
acgttggatgaaaaataaataaaacgaactc

SEQ ID NO: 155 - DNA, 30 bp, artificial sequence
  ALK/ELM4 v3 primer
acgttggatggttctttatcagatatacat

SEQ ID NO: 156 - DNA, 30 bp, artificial sequence
  ALK/ELM4 v3 primer
acgttggatgtacagtgttgaactgtgtgg

SEQ ID NO: 157 - DNA, 30 bp, artificial sequence
  ALK/ELM4 v3 primer
acgttggatgggaaagaataaggagagcag

SEQ ID NO: 158 - DNA, 29 bp, artificial sequence
  ALK/ELM4 v3 primer
acgttggatggtagataactgtaaaaagg

SEQ ID NO: 159 - DNA, 30 bp, artificial sequence
  ALK/ELM4 v3 primer
acgttggatgggaggtcattcatcatagag

SEQ ID NO: 160 - DNA, 30 bp, artificial sequence
  ALK/ELM4 v3 primer
acgttggatgtcatgaggtacctcatgcag

SEQ ID NO: 161 - DNA, 29 bp, artificial sequence
  ALK/ELM4 v3 primer
acgttggatgaagaatcacagttctacac

SEQ ID NO: 162 - DNA, 29 bp, artificial sequence
  ALK/ELM4 v3 primer
acgttggatgaactaaacattgttgtctg

SEQ ID NO: 163 - DNA, 31 bp, artificial sequence
  ALK/ELM4 v3 primer
acgttggatgggtctttttggtaactttctg

SEQ ID NO: 164 - DNA, 30 bp, artificial sequence
  ALK/ELM4 v3 primer
acgttggatggaacttaaaggctaggtggg

SEQ ID NO: 165 - DNA, 30 bp, artificial sequence
  ALK/ELM4 v3 primer
acgttggatgcctgggcaacatggcaaaac

SEQ ID NO: 166 - DNA, 30 bp, artificial sequence
  ALK/ELM4 v3 primer
acgttggatgggatggcttgaatgcaggtg

SEQ ID NO: 167 - DNA, 30 bp, artificial sequence
  ALK/ELM4 v3 primer
acgttggatgcacctgtgcaaactgagcat

SEQ ID NO: 168 - DNA, 30 bp, artificial sequence
  ALK/ELM4 v3 primer
acgttggatggtcacctattgagagggtgt

SEQ ID NO: 169 - DNA, 30 bp, artificial sequence
  ALK/ELM4 v3 primer
acgttggatgaccaaggtggtatcccaaac

SEQ ID NO: 170 - DNA, 30 bp, artificial sequence
  ALK/ELM4 v3 primer
acgttggatgtttccagtggagacacatac

SEQ ID NO: 171 - DNA, 29 bp, artificial sequence
  ALK/ELM4 v3 primer
acgttggatgtcactgcagccttgacctc

SEQ ID NO: 172 - DNA, 30 bp, artificial sequence
  ALK/ELM4 v3 primer
acgttggatgcactgtgcccagctagtttt

SEQ ID NO: 173 - DNA, 30 bp, artificial sequence
  ALK/ELM4 v3 primer
acgttggatgattatgggcatgagccactg

SEQ ID NO: 174 - DNA, 30 bp, artificial sequence
  ALK/ELM4 v3 primer
acgttggatgacatctgggctttgtccaag

SEQ ID NO: 175 - DNA, 30 bp, artificial sequence
  ALK/ELM4 v3 primer
acgttggatgggagacccaaaaaaggggac

SEQ ID NO: 176 - DNA, 30 bp, artificial sequence
  ALK/ELM4 v3 primer
acgttggatggtggttagtagcagtcttcc

SEQ ID NO: 177 - DNA, 30 bp, artificial sequence
  ALK/ELM4 v3 primer
acgttggatggttcttgacatcctctttcc

SEQ ID NO: 178 - DNA, 30 bp, artificial sequence
  ALK/ELM4 v3 primer
acgttggatgcgcgtatttttgctatacac

SEQ ID NO: 179 - DNA, 30 bp, artificial sequence
  ALK/ELM4 v3 primer
acgttggatggtctgccagttaactgagtg

SEQ ID NO: 180 - DNA, 30 bp, artificial sequence
  ALK/ELM4 v3 primer
acgttggatgagatcacctgaggtcaggag

SEQ ID NO: 181 - DNA, 30 bp, artificial sequence
  ALK/ELM4 v3 primer
acgttggatgtttgccaggcatgatggcac

SEQ ID NO: 182 - DNA, 29 bp, artificial sequence
  ALK/ELM4 v3 primer
acgttggatgagctgagatcgcaccactg

SEQ ID NO: 183 - DNA, 31 bp, artificial sequence
  ALK/ELM4 v3 primer
acgttggatggctaaaatttgtgattagctg

SEQ ID NO: 184 - DNA, 30 bp, artificial sequence
  ALK/ELM4 v3 primer
acgttggatgagtaaatcctgtgccacgtc

SEQ ID NO: 185 - DNA, 31 bp, artificial sequence
  ALK/ELM4 v3 primer
acgttggatgggtgaactattttaatgtttc

SEQ ID NO: 186 - DNA, 30 bp, artificial sequence
  ALK/ELM4 v3 primer
acgttggatgtgctttatttgattcagggg

SEQ ID NO: 187 - DNA, 30 bp, artificial sequence
  ALK/ELM4 v3 primer
acgttggatggcctggacagcacagatttc

SEQ ID NO: 188 - DNA, 30 bp, artificial sequence
  ALK/ELM4 v3 primer
acgttggatggtgtatagcaaaaatacacg

SEQ ID NO: 189 - DNA, 30 bp, artificial sequence
  ALK/ELM4 v3 primer
acgttggatggaacgttctctaatgaagtc

SEQ ID NO: 190 - DNA, 30 bp, artificial sequence
  ALK/ELM4 v3 primer
acgttggatggttcttagaagttgggatag

SEQ ID NO: 191 - DNA, 30 bp, artificial sequence
  ALK/ELM4 v3 primer
acgttggatgctcattaatcctgtttaatc

SEQ ID NO: 192 - DNA, 31 bp, artificial sequence
  ALK/ELM4 v3 primer
acgttggatggccagggtgttaaatattttg

SEQ ID NO: 193 - DNA, 31 bp, artificial sequence
  ALK/ELM4 v3 primer
acgttggatggctttttcatttatttagtgc

SEQ ID NO: 194 - DNA, 31 bp, artificial sequence
  ALK/ELM4 v3 primer
acgttggatggtcttttagcagttttatgtg

SEQ ID NO: 195 - DNA, 31 bp, artificial sequence
  ALK/ELM4 v3 primer
acgttggatggcttaagcaaactcatgtctg

SEQ ID NO: 196 - DNA, 30 bp, artificial sequence
  ALK/ELM4 v3 primer
acgttggatggtgggtaactgtaagttggc

SEQ ID NO: 197 - DNA, 30 bp, artificial sequence
  ALK/ELM4 v3 primer
acgttggatggctcttaagaggttaggttc

SEQ ID NO: 198 - DNA, 29 bp, artificial sequence
  ALK/ELM4 v3 primer
acgttggatggcattttgtacttagtcag

SEQ ID NO: 199 - DNA, 30 bp, artificial sequence
  ALK/ELM4 v3 primer
acgttggatgctgtgaaataagaaagttag

SEQ ID NO: 200 - DNA, 30 bp, artificial sequence
  ALK/ELM4 v3 primer
acgttggatgcagctagatcattgaaaggg

SEQ ID NO: 201 - DNA, 30 bp, artificial sequence
  ALK/ELM4 v3 primer
acgttggatgctggaacttgaagtcttttg

SEQ ID NO: 202 - DNA, 30 bp, artificial sequence
  ALK/ELM4 v3 primer
acgttggatgttctagcattttggttgtcc

SEQ ID NO: 203 - DNA, 30 bp, artificial sequence
  ALK/ELM4 v3 primer
acgttggatggtttgcagaaattaagtagc

SEQ ID NO: 204 - DNA, 30 bp, artificial sequence
  ALK/ELM4 v3 primer
acgttggatgctaaagattgtaaaatacag

SEQ ID NO: 205 - DNA, 30 bp, artificial sequence
  ALK/ELM4 v3 primer
acgttggatggctttctacaggtagtaccc

SEQ ID NO: 206 - DNA, 30 bp, artificial sequence
  ALK/ELM4 v3 primer
acgttggatgagtccagaaataaagcaagc

SEQ ID NO: 207 - DNA, 30 bp, artificial sequence
  ALK/ELM4 v3 primer
acgttggatgcactctgcctgaatttttcc

SEQ ID NO: 208 - DNA, 30 bp, artificial sequence
  ALK/ELM4 v3 primer
acgttggatgatggctttgctcagaacacc

SEQ ID NO: 209 - DNA, 30 bp, artificial sequence
  ALK/ELM4 v3 primer
acgttggatgggagtatcagatggcctaag

SEQ ID NO: 210 - DNA, 30 bp, artificial sequence
  ALK/ELM4 v3 primer
acgttggatgcacagaagggaaagtgcaac

SEQ ID NO: 211 - DNA, 30 bp, artificial sequence
  ALK/ELM4 v3 primer
acgttggatgctactgtactccctgatttc

SEQ ID NO: 212 - DNA, 30 bp, artificial sequence
  ALK/ELM4 v3 primer
acgttggatggcccttagcagtatctgaac

SEQ ID NO: 213 - DNA, 30 bp, artificial sequence
  ALK/ELM4 v3 primer
acgttggatgagcatatttttaactcaatg

SEQ ID NO: 214 - DNA, 29 bp, artificial sequence
  ALK/ELM4 v3 primer
acgttggatgctaagtcttcaaaatctgg

SEQ ID NO: 215 - DNA, 30 bp, artificial sequence
  ALK/ELM4 v3 primer
acgttggatgagagcaggtctagatcatag

SEQ ID NO: 216 - DNA, 30 bp, artificial sequence
  ALK/ELM4 v3 primer
acgttggatgagtgttggtttccccttctg

SEQ ID NO: 217 - DNA, 30 bp, artificial sequence
  ALK/ELM4 v3 primer
acgttggatggaacaacagcctttatgaac

SEQ ID NO: 218 - DNA, 30 bp, artificial sequence
  ALK/ELM4 v3 primer
acgttggatgaagtgctaaagctgagattc

SEQ ID NO: 219 - DNA, 30 bp, artificial sequence
  ALK/ELM4 v3 primer
acgttggatgtcaccataccaaggttggag

SEQ ID NO: 220 - DNA, 30 bp, artificial sequence
  ALK/ELM4 v3 primer
acgttggatgctttccttttctggaccacc

SEQ ID NO: 221 - DNA, 31 bp, artificial sequence
  ALK/ELM4 v3 primer
acgttggatggtgaagacaggtagaaagtag

SEQ ID NO: 222 - DNA, 31 bp, artificial sequence
  ALK/ELM4 v3 primer
acgttggatgcaggaaaaagtttgcagtgag

SEQ ID NO: 223 - DNA, 30 bp, artificial sequence
  ALK/ELM4 v3 primer
acgttggatgggttgcaaactggtgttgtg

SEQ ID NO: 224 - DNA, 29 bp, artificial sequence
  ALK/ELM4 v3 primer
acgttggatgggcaggtttcacaataaat

SEQ ID NO: 225 - DNA, 29 bp, artificial sequence
  ALK/ELM4 v3 primer
acgttggatgtcgctgagatggggtatgg

SEQ ID NO: 226 - DNA, 30 bp, artificial sequence
  ALK/ELM4 v3 primer
acgttggatggtgtacataatagactcagc

SEQ ID NO: 227 - DNA, 30 bp, artificial sequence
  ALK/ELM4 v3 primer
acgttggatgcataaacaattgctaaacag

SEQ ID NO: 228 - DNA, 30 bp, artificial sequence
  ALK/ELM4 v3 primer
acgttggatgatgctttacagtgtgatgtc

SEQ ID NO: 229 - DNA, 30 bp, artificial sequence
  ALK/ELM4 v3 primer
acgttggatgcagttaacaaagcgtgaagc

SEQ ID NO: 230 - DNA, 30 bp, artificial sequence
  ALK/ELM4 v3 primer
acgttggatggatctccaacatatatgacc

SEQ ID NO: 231 - DNA, 30 bp, artificial sequence
  ALK/ELM4 v3 primer
acgttggatggcctttgcttttctacttgg

SEQ ID NO: 232 - DNA, 30 bp, artificial sequence
  ALK/ELM4 v3 primer
acgttggatggatactatcactaaccctcc

SEQ ID NO: 233 - DNA, 29 bp, artificial sequence
  ALK/ELM4 v3 primer
acgttggatgtttatgatgtacacctctg

SEQ ID NO: 234 - DNA, 30 bp, artificial sequence
  ALK/ELM4 v3 primer
acgttggatgcaagttgacacttaaaagag

SEQ ID NO: 235 - DNA, 30 bp, artificial sequence
  ALK/ELM4 v3 primer
acgttggatgcagctggtcattttcttatc

SEQ ID NO: 236 - DNA, 30 bp, artificial sequence
  ALK/ELM4 v3 primer
acgttggatgtgaaaccatagtgtgggagg

SEQ ID NO: 237 - DNA, 29 bp, artificial sequence
  ALK/ELM4 v3 primer
acgttggatgttttgagacggagtctcac

SEQ ID NO: 238 - DNA, 30 bp, artificial sequence
  ALK/ELM4 v3 primer
acgttggatgctcccaggttcaagcaattc

SEQ ID NO: 239 - DNA, 30 bp, artificial sequence
  ALK/ELM4 v3 primer
acgttggatgttggccaggctggtctcaaa

SEQ ID NO: 240 - DNA, 30 bp, artificial sequence
  ALK/ELM4 v3 primer
acgttggatgccagcccaagcaaacctttt

SEQ ID NO: 241 - DNA, 31 bp, artificial sequence
  ALK/ELM4 v3 primer
acgttggatgcattattacatactcttctcc

SEQ ID NO: 242 - DNA, 30 bp, artificial sequence
  ALK/ELM4 v3 primer
acgttggatgtttcagtctggttctaatgc

SEQ ID NO: 243 - DNA, 30 bp, artificial sequence
  ALK/ELM4 v3 primer
acgttggatggtaaccatttcacaatcacc

SEQ ID NO: 244 - DNA, 30 bp, artificial sequence
  ALK/ELM4 v3 primer
acgttggatgggggtttttttggttttttg

SEQ ID NO: 245 - DNA, 30 bp, artificial sequence
  ALK/ELM4 v3 primer
acgttggatgaagtttgagaccaatctggc

SEQ ID NO: 246 - DNA, 30 bp, artificial sequence
  ALK/ELM4 v3 primer
acgttggatgtaatcccagctacttgggag

SEQ ID NO: 247 - DNA, 29 bp, artificial sequence
  ALK/ELM4 v3 primer
acgttggatgtgggtgacagagcgggact

SEQ ID NO: 248 - DNA, 30 bp, artificial sequence
  ALK/ELM4 v3 primer
acgttggatgttcacgcctgtaatctcagc

SEQ ID NO: 249 - DNA, 30 bp, artificial sequence
  ALK/ELM4 v3 primer
acgttggatgtggtgaaaccccatctctac

SEQ ID NO: 250 - DNA, 30 bp, artificial sequence
  ALK/ELM4 v3 primer
acgttggatggaggtggaagttacagtgag

SEQ ID NO: 251 - DNA, 30 bp, artificial sequence
  ALK/ELM4 v3 primer
acgttggatggatttgattctagacttgtg

SEQ ID NO: 252 - DNA, 30 bp, artificial sequence
  ALK/ELM4 v3 primer
acgttggatgtgctgccaataaggaaactg

SEQ ID NO: 253 - DNA, 29 bp, artificial sequence
  ALK/ELM4 v3 primer
acgttggatgtatatgtgcatgccacatt

SEQ ID NO: 254 - DNA, 30 bp, artificial sequence
  ALK/ELM4 v3 primer
acgttggatgctgatatctcctcaagatcc

SEQ ID NO: 255 - DNA, 30 bp, artificial sequence
  ALK/ELM4 v3 primer
acgttggatgggaaccttcatcctgctttc

SEQ ID NO: 256 - DNA, 29 bp, artificial sequence
  ALK/ELM4 v3 primer
acgttggatgtttgagacgcagtcttgct

SEQ ID NO: 257 - DNA, 30 bp, artificial sequence
  ALK/ELM4 v3 primer
acgttggatgaggttcacgccattctcctg

SEQ ID NO: 258 - DNA, 29 bp, artificial sequence
  ALK/ELM4 v3 primer
acgttggatgtcatatttgtagtagagac

SEQ ID NO: 259 - DNA, 29 bp, artificial sequence
  ALK/ELM4 v3 primer
acgttggatgattacaggcgtgagccacc

SEQ ID NO: 260 - DNA, 30 bp, artificial sequence
  ALK/ELM4 v3 primer
acgttggatgttgtgatctgcatttctctg

SEQ ID NO: 261 - DNA, 31 bp, artificial sequence
  ALK/ELM4 v3 primer
acgttggatggttatttaactattgagttcc

SEQ ID NO: 262 - DNA, 30 bp, artificial sequence
  ALK/ELM4 v3 primer
acgttggatgcgttctgtaggtggcctttt

SEQ ID NO: 263 - DNA, 29 bp, artificial sequence
  ALK/ELM4 v3 primer
acgttggatgcaagtgttagaaaaactgc

SEQ ID NO: 264 - DNA, 29 bp, artificial sequence
  ALK/ELM4 v3 primer
acgttggatgcttgtagaaatgtgtcaac

SEQ ID NO: 265 - DNA, 29 bp, artificial sequence
  ALK/ELM4 v3 primer
acgttggatgcactttgttttctgtatgc

SEQ ID NO: 266 - DNA, 30 bp, artificial sequence
  ALK/ELM4 v3 primer
acgttggatgtgggttgaaaatatttgggg

SEQ ID NO: 267 - DNA, 30 bp, artificial sequence
  ALK/ELM4 v3 primer
acgttggatggagtaatctagagatgattc

SEQ ID NO: 268 - DNA, 30 bp, artificial sequence
  ALK/ELM4 v3 primer
acgttggatgggtatctgaggaaggtgttc

SEQ ID NO: 269 - DNA, 30 bp, artificial sequence
  ALK/ELM4 v3 primer
acgttggatgcttgtttttattgtatcacg

SEQ ID NO: 270 - DNA, 5892 bp, Homo sapiens
  misc_feature: ALK/ELM4 v1 rearrangement
actcaggtggagtcatgcttatatggagcaaaactactgtagagcccacacctgggaaaggacctaaaggtacagtattcttatattaaactcatttctggtaattctcacatagtactctttcagtcccatctcttagaccaggagagaaagagctgcagtgtaacaatatgagcaagtcaccaacataccttttgttttcagcattcttcataatctttttttaatgaaattatttatccagttatttattaagcttatataacccacatttgactatactgaaccattccctttaggaagttaataattagaaagaaatgatatggatatatgttagtttaaaaagtataaaggctcactttcccctgagctggttctgggatatctgttagagcagaatgcatggccatgtgataaaatggaagagtggagagaaaaggaataaactcatagttcaatccacttctcctttttcttttcctcactgcagcccttcttcccaaccttagtgtaggggtccttggcatccattcagctttacctcaaatcagttttcctaaaaaacacagatttattcttaagttttatttgcacccaaatatacaggtcctctttgcccttttctacggtaaatgaaaaaattagaggaaggacatggaaaataaccttttttaaaccccatttttcgttactatttaagaataatcaaactttgaaaaaaatgtccagagtaccatgtacttccttcagagtaggaggttctaagagaaaaattggagacctggttctaaaaccagtgggccaggagaagagagagattcttagcagcaacaggtggtaacagtagaaatagaactagctaggtcagccagtcctcaataattcaccaaaaaaaaagtaagaaaggaggtaatggggaaatcaccctgagttttctgagacatttcccctggggattggcagggcaacatgtcctttctcttgttcattcacctcccctaaacacactggaacaacaccttatacttctctctctctctctctctctggagtccttgcatcagaccatgaaaatcaccctaagtgatttatgaataagggaatccctgttcgtgtgctcagaaagacccgatttacatatctgccttccccaataagctttccctgggctagcacagtgtctggcatttgctattagctgtttgaaaactatttgtcaaacattaaggaaataactttcatcttaactttgggtgtcaatgtaggagtaaaagttgagtagtattgatgaaagcactgttttcaccgaaatgtggaatttaaatttcgcattactgttttcttatgactgcacagagtttcatactgtattttttaggacagatattcagatgctccttgacttctggatggcattatatcccgataaatctatcataatgtcaaaaaataataaattgaaccaacataagttaggcactatctgtacgaaattaatgttttaattaaatgtttttcaaatccattcacctgaatgtctaagcttggcagttgaattagacctattaagaagtttaaaacaagaagccttaaattgtattaccattgactcctatctcaatcattggccatatattcttagcctctttcgttcagtttaggttcaaaatttacacacgagaagaatggcagtgggttgagggttcttaaaaaatagagttacaacaacaatatattatcaactacttttcccatttatttctcttttctttttttcttatttttctttcctgggcacatttacttagtatcagaaatgccaggaacagcatagtctattaaaacagtgacttttaaattgttcacgaatctccaacactgagcagaatttgcgtataaatatacccttttgttagccttaatatttgtgttcaggttggggacaggaagaagaggttcagaggtttttattttggtctttgaaaaatttgtggctcaacctctctacatatgcacaaacaggaaacaggaaatccaatcttgtaaattgctgggcacatgaaatggcctgtgttgtactttgccacatgactaaccctattatgggcaaagttgctaagaatttgaggttttcaattggctgggaagaatttggtgagcgcagtgaaataaatggaagtccagaccagagtaagtgtccacagtttccattttttaattctggcccccagatttcagtagatccaatttacatattcccaactatgacatttctgcacctgtggcagtcttaccaaccaaaatttgagtgtactgtgacatcctgtctgataaaaggagattttttggatggcagaagtataatttcacaactaatccttttacttttgtaataggagacaaaccaaaactgtattttatgtcttaaaagtgcttttatatatttttttcttgtttccaaaccatttcttccttaaacatgaattaatgtgaatcttcaaagtaattagtgttttctgtttcttaagtaggtatgaggtatttgttatttatttcctacacatatgaaatagattgaaattgttcttatgcaaaataatttgtaatcttttaagtgggtaagtggaagttgagagtatctacagaaccattaaaatgttcaccattcttaagtcttgcaaaggagctaagaaacactgccattttatgtgttctccgaataatcaaatgggcccagttgctaagaatacaacataaatttcaaagtctccctaatattttattctttaaacaggcacagaaagccttccaaacatctttatttggcaggcagtgtaaacttgctttttatggaagctttgtgtctgttagagatgagaagaaagggtgaggtttgtgattaagtttggatggacttgaccatatgagtaagcctgaaggcagagtaggtttttttaattcaaggataattattttccttggcagggatttcaaacattatttggcaactgaaatatcagaaatacaggcccataagaaagacatctttggctataaatttgttttacaggtaaatactatataaaggaaactttgataatttgtttaaattagaaacactaaattttttaagctaagtcgatactaggtccacctcaggaaataactttcctggagtgagaaggactcactgacttgatcactatatagagtatttttatttctgatgaagcatttttttcttcatttttttttccagttttccatcattctgggaggattttaagtgtttaacaaggtttttgtcatgtttagaaatacggaaagcagacttaagcatagaaaagctttattttcttacattctgatagagaactatgaaactcccacacctttgctttttgtgttttcttacatgataccttcaggctactcttgttagtttgaccatgcacagggaaataagcctagaatttgcttttctctatttttattatccaaataaagccagtagtactctcagaaaattctcatctctcaggtgtcctccctctcgtggtaacatcagaacagagatagatacttatctacctatgccagtgaacacagttgtgttgttcaatttttaaggtatttttagatgataaatattgatgtaagtggagacagttgacctgaacagcaagtttgttggagttctacttccagctctgctgaattgggcaagttctcctccaaatcaagcaagccctttcctgtctccctgccatatatacccatctgttaagtatttgtaccactagcatactcaaactgagacataattttttttaggataccaaagccttagaaattttagtcaatttgttaagtataatagcagctcaaatagatgagtaaaaaagaacaatctcagtaacaacttcgatatataattcacataccatgaaatctaccctgttgaagtatgcctttaagttcagtggtttttagtatatttacaaggttgtgcagccatcaccactatctgacctaaggacattttcatcaccccaaaaagaaagcctgtacccattagtagtcactttctatttctccctcccctcagcccctaggtaaccaccaatttcctttaggtctctatagatttacttgttgatgacatttcatataaatggagtcatacaatgtgtggtcttttatgacttgcttctttcacttagttttttttgttttgttttgtttgtttgttttttgagatggagtttcactcttgttgcccaggctggagtgcagtggtgcgatttcggctcactgaacctccgcctcccaggttcaagcgattctcctgcctcagcctcccaagtagctgggattacaggcatgtgccatcatgcccggctaattttgtgtttttagtagagagggttttgccatgttggccaggttggtttcaaacatctgacctcaggtgatccacccacctcggcctcccaaagtgctgggattacaggtgtgagccacagtgcccagccttcacttagcattatgtttttaagattcatccatgtggtggtagcatgtgtcaatacctcattcctttttatggctgagtaatatcacattgtatagacatactgtgtttttaaaatctattcatcagttgaggaacagttttagaaaatgaatagttgttaaacctgaattttttcaagaggactaagggctgtttattgacttactttggccatatttcaataaggttctaccttcccattttgaacctggtaactaattctgtaggacatcatcttccaaaaagctttactcttgctctgctagcctatctagctaaagagcttctctgagtaaggcatttatgaataccaaagaaaaaggtatgagtactatcatcttattctcacccttaaaagggggcaaaatataatttaaaaaaccacatgtgtttgcctaaaagaccttttatgtacccccttggtctctccctgggtacttaacaaagtgtgctatgggtatacaagaaaactgggctgttatttagccatcacattggtacagctgaatcaatttttaaaatactgaaattattctctgctagtaggtcaaaagccatcactgcaggtatccattgcctacctttgtcccaataacttctgtagtgcccccatatctcagcaaataaaggggagtaatccttggcacagcagaaggcctctgggttaacaatggttgtaaaacgttaaacgttgtgactgttacctcagaaggtcaaccaaagatgtttttgcaaagttaaaggaacatcaaggtgggagacttgagcctagtcacagctttgttattagctaactatgtggtatcccctaagctgctcctgtacctcttgtgtcttgagctctcatatcagaagagtgacacctaccctagctaccatacaagatgattatgagagatagtaaagttctgaaacctatactatatcccctttcgtctgtggaattatcactacttttgctttggttttttgtaggaaaatattttgaaatattttcagagtaaataaatattgacagaaatgcaaaagattgtattataccctaaactttactacctgctttgcacaaaagacttgctgaaaataggtttttgattgagtcatatgaactttctgattattaactctagttctactgaagttttcttccaaatagacactaaaatctgaagaaaagtattatcactagtgtttttatttttccctcatattaggtgtatatcaaatcagcaaacaaatcaaagctcatgatggcagtgtgttcacactttgtcagatgagaaatgggatgttattaactggaggagggaaag

SEQ ID NO: 271 - DNA, 750 bp, Homo sapiens
  misc_feature: ALK/ELM4 v2 rearrangement
gctacatcacacaccttgactggtccccagacaacaagtatataatgtctaactcgggagactatgaaatattgtactgtaagtatgaatgattttatatatatatatatatgctatgattatatttatatatatatatatatatatatatatatatatatatgctaagatgtgtctgtcaggggcgctaatgaacaggctgcatggaatctgaattgtgcagagaatgcttgccaacctctttaacctgacaaagcatatgttatgctgagctaaggtaatgagaatctcaaatgtgattcacttctccaagagtaatgaattaatgttaatagtgtagaacagaaggcacatatagtaataagaaattactctgtcaaattgatgctgctctgaatggtttttcatttaattacttctcctggaggcagggaggaatatgatagatgggcatttatgctttttagaggaaaaaaaaaacttccatgggaaacagtttgtagttttataaaccctgttaaagtgaacactttcttttcctttttaaatgtgtcttaatgtttttcagtgtatggattataaatacaagtaaacgtggctagtttgaatcaagatgcactttcaaatacatttgtacacaagcactatgattatacttcctgtttctaaatttaaaggggacattccaaatggctgcaaactaatcaggaatcgatcggattgtaaggacattgattggacgacatatac

SEQ ID NO: 272 - DNA, 16250 bp, Homo sapiens
  misc_feature: ALK/ELM4 v3 rearrangement
attttaatggttagccatataaacttataaaataaatgtgtttcttaaatttcttttctaggcataaagatgtcatcatcaaccaaggtaaattaaaaatccttttaaaaattttattttgcccttcttagtttaatttttgctaattgaaaagaatattttcatccagtgcactttatcagttcatagtaatcaaagaaaagtgcgttactgtagtcatttaggaaaaaacccagtttttattgtaaggtaatgtcatttttgtctcaaccagcaaaaatgtcaactcgcgaaaaaaacagccaaggtaagaataagctacgcagttggttgccttctaagtgaattttttcctggatctcttatttggctttttattatttatgctgcctgactttcttccttaaaaaggaaatacagtgatttgagctagatgaatccagctacattttacttttttttttgagaccgagtctcattctgttgcccagggtggaatgcagtggtgcaatctcggcttactgcaatctccacctcctggggtcaagtgattcttgtgcctcccaggtagctggggactataggcaccaccacacccggctaatttttggtgttttttgtttgtttgttttgtatttttagtagagacggggtttcaccatgttggccgggctggctgcaaactcctgacctcaggtgatcagcccgcctcagcctcccaaagtgcagggattacacgcatgagccatggcacccggccaatttttgtatttttagtaaagatggagtttcaccgtgttggccaggctggtctcaaactcctgacctcaagcagtcctcccgcctcagccccccaaaatgctgggattataggcatgagccaccacacttggcccggctgcatttttaaaaatccatcttatttctaagaaatctgaagattcaaggtgaacagtaaaaatacagtattacaaaaagggataaaatactagagggagttttctcccttaaaaaaaagttttacctagaaataaacgattgataaattttaactcagtttcctgtcttgccaacttcattgcaaataatcactcatttcttgatgctaagactgaaaatatgatgagtctagcaaatccatttcctcttaagtttttcttttatattgattgtaacttctggctacttgctgttgttggcttgttcagaccaaaaaaagagagcagacttttggcgaatgcgtatttaatttaattgcactgtaggtaagttttatacatcagttttacattctctttagattgcctgcaaatttaattgaagcatgctgttcttaatgaaagcacgtcctttctgtgcatggttttcacagctcatttctatgtttcatagttagccttattttctgttctattatagtaaccagctgcaacgtggttaaagctttttttagagatttaacttgatttctgtggatttttacttctttcgttccaaaaagaaaagaaagaaatatttgtaatagtctttaggtcatttgtttttacatagacattctaaatgaagttgaattttgctggcattcttctttagtaggtcttactttctcccttctttataatacaacatagattaagtaatgtttgagatactttaaagggaaaaatgaaattttatttatgaagataattcttaatacattatatatcaaaacttttaagagagagggtcttgctctgttgccccggctggagtgcagtcactgccttggctcactgcagccttggcctcctgggctcaagcagtcctctcactgaagcctcccaagtagctgggactacaggcgcgcaccacatacctggctgatttttgtatttatcatagagatggggtctcactttgttgcctaggttggtctcaaactcctgggctcaagcagtcctcctgcctcagcctcccaaagtgttgggattacaggcgtgagccaccacttctggtccgaaaacttttttttttttttttaaatagagtcggcggtatgtgataggaagagcagtgaatggggaataactgtgtttagtggttggtcctggctcttatgcataatagccttatgacctaggctgaatgacaatgtctctgagtggttttctactctaaatatagtaactataaagcttatttcacatgactactgaaggatgaaataatatatatgaaatataaattgaaatatagtggcatctactgaaatagggaacatttgaggagaaggagatgtgtggaaaaggagtttggctttggacaattgcatttgagttgtctataaaacttaacctacatgtagagatgtatagcaaacaatgtcatgtagatgtttaaacacatggattttggagtccagagagtggttttaccattgacttagctatagtgacattgagcaggttacttcaacctccctaagtctttgttttctcatctgtaactgagataataataagccattaaagggttactgtaaaaattatagtaataaagtgtacccagtacctgacatataataccaggtaagttttagttattaatatatgaatttggcagtaaaaccttgcactcagatttgtattatcagatgaaaagataattattaaataggtgagagtcattgactgtaagttgtatagctattttagaagtgtggtattcattttgcatggcatattcacaacacattttctagtatttcagctattaatgctaatatttgtcattttttgacattctttttaaaatatgacattaatttagcctctttttgacaatgatagctgtggcttgttccaaatcatctgctttgatttgagaagaagcctatttacatatggtacatttaggtgagtggtaacagagaatactttacctgaaaggcctgtgtccttcagacagagcagagtaggagaaaagctagaaagctgcatattccagtcaccacttaggcagaagtcaggaaactggttgttgaaagcaatagaaagtgaaatgagatgtacgcagggcaatctctgaggttaggtgtgagaggaagggcaggttatgccactaaaaagaggctcttactgacctatatgtttataccctgaaacctaaactttttttcattactctctcccctagttctgctgggttgtgctccagatacagcagagataaagtcctagcatgtcaacttaaaatttgaataagttccatgtaggactatctattgttagaggtagcagttaggttgtagtacaataatattcactttggtgagttactgattttaaaaaattttccaagctaagttgggggacttcaggcaccatgtataaaattgcttattgtggaaaatagataacaatttgacaaattttctaataaacaaaatgatactgccattaaggtcatccttgaaatagttatcaagtacaactggccttccatatctgcggatttcacattcctggattcaaccgacctgcattcgaaatattaaaggaaaacaaagttccatctgtggtgaacatgtataaacttttttttgtcataattccctaaacaatacaatataacaactaataagtaatctaaagatgatttaaagtatacaggaagatagtcatagattacatggaaatactataccttttatatcaaggacttgagcatccacagattttgctctctgcaggagatcctagaaccagtgtcccatggaaaccaagggaccaactatttatttcatttcaaatttattatttatttatttagagacagggtctcactctgccaccgaggctggagttcagtgcacgatcataactcactgcagccttgaactccgagcttgagtgaccctcctgcctcagccttccaagtagctgagactacaggcacataccacaacacccagctaatttttgtattactttatagaggcagggtgtcactgtgtttcccaggcgtgtctcaaacttttagcctcaagcagtcctcccatctctacctcccaaagcgttaggattatagctgtgagccgccgcacctggcctacattttttagagatggaaaataagtgtcacatgatctcattatttctggaggagaatctgaatgtcctcaaaatgtttttttcagacttgaataatcttaaatttaatttttctcttgtagaacttcaaactaggcctgtttagatttaacacataattacctggtcatgttgagaaactgaatgactcagatctctactggaaagaaatctgcttattttgaggaaaaaggaagtcatcaatcactaaatccaagtcttcctcttactgtgctgcctccctgctctaggattagattcattgttatttaccatttcagtacagtgatatcctaactgtacaggtatatcaaaatggaaggacagttataatatcttagaaaattgagaagtaattgactgttagctacctgtccaaaaatggcttcagattaaaaatacttgaaaagtcattttgaattatatactgtctaaaatccctcagtaatttattgtagccaaatgctttatcaaataatttaaaaataaataaaacgaactcatttataaaattggggaaaggaaaaaccctgaataatcttgtcattctaacaggttacagttctgatgtgtttctttattgttctttatcagatatacattttatacattcattcattcatttaacagatatttactgagtgcttattttgtcagaccctatcctaggcattcagagttacagtagttacagtgttgaactgtgtggaacttacattcatgctccatagacaaaacagataaatacttcatatgtcaggaaggtgatatatatgaggaaagaataaggagagcagagaattgctattttatatagagtagttagggaagacatttctgatatggtgacctgaaggaagtgaatgaaatatgaagtatgtagataactgtaaaaaggattttatgaacagaggaagccgttcataaaagtatataagtatataagcctctaggcaggaactttcttgctctattaaggaatagcaaggaggtcattcatcatagagtacatacaattttgtattatttagcaattacatttataaaatacagattcattccaagcaagagaagtttcatgaggtacctcatgcaggaaagggaagcaaagtgatatagcagaaagggcaaatgagtagtaaacatgagacctagttaggggtaaaatgacctgtatcacagaaaattaaagaatcacagttctacactatgagttagataactcataactttgggagaagctgaaaattccatttgctaaaggaaatgattttagaaaactaaacattgttgtctgataaaatttttcctgttaccctgagactttgggtctcagtttccttacacatatttaggcttagattagatatcactaaggtctttttggtaactttctgaaagctttttcttggagcaaacaggaaaggaaggacagttgcctcctgtccccacaataccttcactaacttgcttgtgaactaccttttgaagaacttaaaggctaggtggggtggctcatgcccataatcccagcattttgggaagccaaggtgggtggattgcttgagctcaggagttcaagatcagcctgggcaacatggcaaaaccccatctctaccaaaaatacaaaaaattaacgaggcgtggtggcacacgtgtagtcccagctacttgggaggctgaggtgggaggatggcttgaatgcaggtgcttttgttcagagccttgcattatgttttctgaccttttggctccaggcacatttagtcctaaaatctgttcacacctgtgcaaactgagcattgtatctgaaagaatagctaaaatttatcgataaagatatataatagcggtgtcctgctgactctgtatattgtgtcacctattgagagggtgtatattgtcatttactgagagagtgtgcagtttgaaacaaatgaaaaaagtcaaaagcctttaatcgaactacagacagattctttcctttttaccaaggtggtatcccaaacttggcaattcccgaatttaggaagaagtttgttgagtgtggataaacagaaaggacggaagaccaatgcatttccagtggagacacatacttaattctaaaacctatgtattttcttttttatttttgagatagggtctcactgtgttgcccaggctggaatgctgtagaatgatcacagctcactgcagccttgacctcccgggctcagttgatcctcccatctcagcccccagagtagctggcacataggaatgtgccactgtgcccagctagttttatatttttagtagagacaaggtttcgccatgttgcccaggctgttcttgaactcctgggctcaagtgatccgtctgcttcagccttccagaatgctgggattatgggcatgagccactgtgcctggctagttctaaaatttacatactgtcccttttaataacctgtataaccataacttggatccctacatctgggctttgtccaagtattctctgtatttttatttattttatttaagagggtagagaaggcactgccaaggacagcaggcccgccaggccgctggtctcgccatctgtattttaaaaggagacccaaaaaaggggacctttcctctgttggagatttttttttaagccctataaagcaaagatctgatttcataatgttgtggttagtagcagtcttccagattaaaatatgtttgaaggctgtccaattttttaaaatagaaactatcccaacttctaagaacatgttcttgacatcctctttccttattttcagcgaagaaaaaagccccaactgccttctctggacatcaagtatatgacttcattagagaacgttctaatcttatacgtatttattgtggttaaagtcttttcattcaaattacgcgtatttttgctatacacatactttttaaaaaaatctaaactagaaaatgtaattaaccagaaatttttcagtcttcaagtctgccagttaactgagtgaaatattttcatagttagaaatctgtgctgtccaggccgggcacagtggctcatgtctgtaatcccagcactttgggaggccaaggtgggcagatcacctgaggtcaggagtttgagaccagcctggccaacatggcaaaaccccatctctacaaaaatacaaaaatttgccaggcatgatggcacctgtctgttgtccccacctacttgggaagctgaggcaggagaatcgcttgaacccgggaggcggagtttgcagtgagctgagatcgcaccactgcactccatctcaaaaaaaaaaaaaaaaaaaccctgtccaaaaatggcagttatattctatactgtatttcttactctagtaattgttattgttttctagaagcactttgaaaagaatgctaaaatttgtgattagctgtagccaggaagagttgcggttgatcagtggcatataccaagatttcaaggaaaaagcatagtaaatcctgtgccacgtccctgaactacactcacaattctccaaagaacagtttcaccaaaaatattctattgttttcctttaataatgctttttaaactttggtgaactattttaatgtttctaaaaatatattcaaataatatagtgagcacctgtatactgaccacccagatttatcagatctttacattttgctttatttgattcaggggtttttttcatttgttttggtctcaaactcctgacctcgggtgatctgcccaccttggcctcccaaagtgctgggattacagacatgagccactgtgcccggcctggacagcacagatttctaactatgaaaatatttcactcagttaactggcagacttgaagactgaaaaatttctggttaattacattttctagtttagattttttttaaaaagtatgtgtatagcaaaaatacacgtaatttgaatgaaaagactttaaccacaataaatacgtataagattagaacgttctctaatgaagtcatatacttgatgtccagagaaggcagctggggcttttttcttcgctgaaaataaggaaagaggatgtcaagaacatgttcttagaagttgggatagtttctattttaaaaaattggacagccttcaaacatattttaagaaataacattatagttgaaacttctcattaatcctgtttaatcagaatttttatatacaggtttttaatgttctgctgaggcctcctgattgcctccctgctatagttaattgagaaagcagagccagggtgttaaatattttgacatttgaagtttccttttcaaatttcttatttttaaaaagttaagtgcaacttggtatattcatataaaatgaaaagctttttcatttatttagtgctttaaataatttttcctgaggatataagtgaatgagttgggagaattttaaaaataaaaccatattttgcctacagaaaagttttaagcagtatagttagtcttttagcagttttatgtgtctcatattgttgaaatagatttcttttccatcttttcccaataaagtcatttcaagcagtaaaaataatctaaaatgcttaagcaaactcatgtctgatattttcaagtaattttatgacagaattgtaaacaaaacatcaagagaaatctgattaaaggagtttaggttcaagaaggtgggtaactgtaagttggcttgctagtgtaattagtataagagttgattaacaggtgcacaagacatggttatgtctccaatctaagctcttaagaggttaggttcatatcttttacactgtgcatcccccaccccactatgtaattaaaaattcaggaaattttatcagccaatagaagaaaaaaattaaagtagcattttgtacttagtcagattttttcagacccaagttttatgctagctaataaaactactaatctttagcaagtactggaactaaaaattttttaaatctgtgaaataagaaagttagattatacccttctaaattcccttttagtttatttggttatctacattttatgatttaactatttttacagctagatcattgaaagggggcaaaatccaaacatgcttacagattccattgtttcattggaattttaaaatactgaattataaccagaaaataactggatcattaactggaacttgaagtcttttgtttggataaagaacctttttaagaaaagattttagccttccaaaaatggtccttgtcactttctactataaaattacagtaaatatttctagcattttggttgtccttttgtttaactctgtggttttgggaagtagagactgatagtatcagaaaaaaggctcaaattaagtaaagattctttaagtttctgtttgcagaaattaagtagcatcatactctcctacctttcagttaaatataaaactcaaattccagtttgggggaggctttttagttctaaagattgtaaaatacagattaaaaaatggattcctaaaatggaaactttcaggagaaagatgctttaagttgtaagcaatctaaacgttcagaaggctttctacaggtagtacccattacacaaataattacaatcacagtccaaatccccgaagttctgctgttgcctttgaaaggctttttttttctttttaaacaatctctaagtccagaaataaagcaagcttaaaaagaaaatcactggagcaactgatcttggaatggagtatgcccagagccatctcccttctccactctgcctgaatttttccttttcctttgttacaatttgtgaacgattaatacttttttataaggatcttaaattactttaaaaaccattatttatacgtgagtatgaaccattttgaaaatatggctttgctcagaacacctgagataactgtcccaaaagaatgagagttttgattagggaatatgataaccactttgcaatttgggacacctcggagtatcagatggcctaagggagatacaaaagtagaagagcaaaacccaaggaaactgaagggcaagcattaggaggaatgggtgaaggacacagaagggaaagtgcaacatcaagtatttcaattttttgcctaacaatcactctttccaaagatagtagagcagaaacatcttcctcttctactgtactccctgatttccagctgttgggattcagagctcaagctagtactatttggattaaaaggaagctgtattgtcacccggtaactggactagcctgaggcccttagcagtatctgaacagcactgcctaatggaaatacaatgtataacgcatatgtaattgaaatttttctagtcaaatttttaaaaagtcacaagtaatattaagttttaatagcatatttttaactcaatgtagccaaaatactgtcattttgatgtgtgatcagtataaaaaaattattagtgagatattttacttttcctttcatactaagtcttcaaaatctggtttgtatatttccagtatatctcaattcagactagccacatggtaagtgttcagtaatcagtgtcttgtcattttagacagagcaggtctagatcatagttttagagtggaaatgtttcccgagttctaagtaatagaattttggaacaaagtctaaaaatttatttaacctctctgagtgttggtttccccttctgtaaaaggaggttagactaggagagctataagatttcatccagccccaacattatatgtgtctggggaaatgaacaacagcctttatgaacaatatcctacagaatttcttctttaataattaaactactctatcactgatcagattgacttaagaatatttatgttgtttgaacataagttagtaagtgctaaagctgagattcaaaccaaggtctgtatcacaaagcttgtcttctcttcactccctctcagtcccagaaattttcaccataccaaggttggagataaaatgttgagtctggttatatttaagttagcatcagcttcattattgaatacctcatactgtgtttaactatcatgaggcaggtagttttcctcactttccttttctggaccaccagactttgtattgttactgatctcgtattctgctttgatcagtcccatcgcccatcccttattgagtttcctggtggtttatagtgaagacaggtagaaagtagcattgggataatacatactgactataagttttatgattgtaagatcaagaagcccgagaatctcaggaaaaagtttgcagtgagaatttgacaatgactggggagaaaagaggctcctcttcatctatgtattttacctaatacccaaggtaaagagtgtcttcctaaaagaagaggttgcaaactggtgttgtgtgcaggccaaaggtatgttttcatatgatgtttccccttttttggtagaggagtaaacattttaaaattggcaggtttcacaataaattatagattttctatttcttttgaaaaataagaagacctagtaccactaggtccacattcttcatggagtggccttgctgctccctcgctgagatggggtatggggtattcgaatacagtgtccccaccctcagtcatcatgtactctcccacttctctcattttcatttcctgcaaatgaatttgtgttgttttaaagtgtacataatagactcagcagaattctagtttgcttacttgctgttctgcggacagtcactttaaagcttatgaaaagatactatagtgtactaaatcataaacaattgctaaacagtgtttagagtggtcataaatccctttcaaaggcaaaaggataaatatgtcaataacctcatattatgctttacagtgtgatgtcttatttaatcacttataattccaaacagtaggtagtattatcactttatgtattgagaaaacgaagccagtcttgcagttaacaaagcgtgaagctaagattcaagtcgtaatcttttccaaagctcatgctgttttcactataatgtattgccagaaattgtttgaagtgcttaggttatatacttgatctccaacatatatgaccaatttatagatagtgaaagcattgtcatcctaatatgcattgccatttttatatcatatcagaaaagttagaagcactacatcatgcctttgcttttctacttggtttcttaggctgcttgacacttgatacccaatatggtgttctgagctgtgcctgttcaaaaaggagagcatttttttttcttccttgatactatcactaaccctccccctttgctatacctacactcctttctaagtggtgatagaagcatctattaaatgtcttttttattcagaaagtatttatgatgtacacctctgataaaagatcctggaataaattccaaaggatgagatatctgccttcagaaagtttgtaatcttaaaaactagaggaaaaattatataacaagttgacacttaaaagagtaaactatacaaataaggacaaggaaatacagatcaggatgactgcagaagtagggaatatttacagctggtcattttcttatcaaatttcagctatgctaaaaatcatcaggaagcagagcccactcttagattcagaagtaatgaagacgtacatcatgtgatgttgaaaccatagtgtgggaggccttagcctgttcttagatcaaactctgaggccaactacactgagtaataataataaaaataacttgaacttctcacccataacaagcacaacctttttttttttttttttgagacggagtctcactctgtcgccaggctggagtgcagtggcgtgatctcggctcactgcaacccccgcctcccaggttcaagcaattctcctgcctcagccttccgagtagctgggattacagacatgtaccaccacacccagctaaattttgtatttttagtagagacggggtttcaccgtgttggccaggctggtctcaaactcctgacctcgtgatctgtctgcctcggcctcccaaagtgctgggattacaggcatgagccaccatgcccagcccaagcaaaccttttaatctgactgaagaaatacttgcagacattcaagaagtaattaatctttccttcctcttcatggtttgcatcatataaactactgcattattacatactcttctccttaggtcgtttaagtcattattagagatcctaaggttgtatcagcctctggttgatgatcacattttcagtctggttctaatgctattttcatatcatgccagacaagttggcaagtgctagacatttcccatgtatttgtactaagtctttgtctcccctttagctccttttgtaaccatttcacaatcaccatcaatattattaaacctgttgtatgtaggtcactgggatgctagaggcagggttaagtcggggtggggtttttttggttttttgttttcaaaggactaagaaacaattgcggccgcatgcggtggctcacacaggtaatcccagcactttgggaggctgagggggcgcggatcacttgaagtcggaagtttgagaccaatctggccaacgtggtgaaaccacatgtctactaaaaatgcaaaaatgagccagttgtgatggtgcatgcctgtaatcccagctacttgggaggctgagtggggagaatcacttaaacccgggtggcggaggttgcggtgagccgagctcatgcgactgcactccagcctgggtgacagagcgggactccatctcaaaaaaaaaaaaaaaaaaaaaaaaaaaaaatccatcagttgagtgaagtattttcttttgtaaaagatgtgtaatattgcccaggcatggtggttcacgcctgtaatctcagcactttgagaagctgaggtggttagatcacctgaggtcatgagttcaagatcagcctgaccaacatggtgaaaccccatctctactaaaaatacaaaaaaattagcaaggcatggtggcacatgcctataatcccagctactcgggaggctgaggcaggagaatcacttgaacccgggaggtggaagttacagtgagccaagatggcaccattgcactctagcctgggcaacaagagcgaaactctcttggaaaaaaaaaaaatgtattgatttgattctagacttgtgttttttaacgttttagttttagactgtcgcagatcttataaacacctattggtttatgtaaatataagatacctatgctgccaataaggaaactgtttcttagcactgtcttgaaaatctcagggtattatatttgaaatcttgaggtcatgtttttgttttttattattgcaagatgtgtgtgtgtgtatatatatatgtgcatgccacattttccttattcagttgagtttaggttgtttccacatcttggctattgtgaatagtgctgctgtgaacctgagaatactgatatctcctcaagatcctaatttcagttcttctagaaaatacccagtagtgggattgcagcatcatatggtagttgtgtttttaactttttgaggaaccttcatcctgctttccatagcgactataccattttgcattcctaccagcagtgtacaagggtcccagtttctccacatcctcatcaacacttgccgtcttttttttttttttgagacgcagtcttgctctgtcacccaggctggagtgcagtggcgcgatcttggctcactgcaagctccacctcccaggttcacgccattctcctgcctcagcctcccaagtagctgggactacaggtgcccgccatcatgcctggctaattttttttattttttattttttcatatttgtagtagagacggggtttcaccgtgttagccacgatggtctcaatctcctgacctcatgatctgcccatctcagcctcccaaagtgctggaattacaggcgtgagccaccgcgcccggctgtctttttttattattattattattattattaatagccatccgacaggtataaggtaatatttcattgtgattgtgatctgcatttctctgatgattagtgatgttgaacagttttttgtatacctgttggccatttttatgtctttggagagactacaaaagaaaagatgtccttagtccattttaaaatctgttatttaactattgagttccttatatatttttgagattaaccctttattagatatatggcttgcaaatattttctcccgttctgtaggtggcctttttattgttgattgtttcctggcataagaaaaagttatgccgtttaacatctgtaggttcatccagtagcgtggtagacatggttgttgtctatccaaataatctcactcttcttttcaagtgttagaaaaactgctgtcacaaaattttctttagcatttttctactcagccttcctggacttcttgtagaaatgtgtcaacttagataaattatattttaattatcaaaaaattattctcagttaaggaaatggccattggtttatttttccctacaatgttttagactaggactttatagtatcactttgttttctgtatgctgtgtaatgtagttggccctctgtatccatgggttctacatccacagattcagccaaccatgggttgaaaatatttggggaaaaaaattgtctgttatactgaatatatgcagacttttgtcattattttctaaacaatacaacaactatttacatagcattcacatcatattatgagtaatctagagatgattcaaaatatacaggttatatgtgaatactatgccattttgtatcaggaaattgagcatccatggatttgggtatctgaggaaggtgttcctaaaatcagtcccccgtggatacaggacaactatataacaaaaacaattgtatataatgagactaaaactttgaagtagtcatttttgtcttgtttttattgtatcacgttaataatccacttttgtatgactatacagaaaatacgtatgacttaacttttgtcttgtgtttcaacagaaggagaatatattaaaatgtttatgcgcggtcggccaattacca

SEQ ID NO: 273 - DNA, 17 bp, artificial sequence
  ALK probe
cccccttgggagtccct

SEQ ID NO: 274 - DNA, 17 bp, artificial sequence
  ALK probe
attgacaccttggcacc

SEQ ID NO: 275 - DNA, 15 bp, artificial sequence
  ALK probe
ggctgccctaatcac

SEQ ID NO: 276 - DNA, 19 bp, artificial sequence
  ALK probe
aagcagctgctctggtggg

SEQ ID NO: 277 - DNA, 16 bp, artificial sequence
  ALK probe
aggatacacacggggc

SEQ ID NO: 278 - DNA, 19 bp, artificial sequence
  ALK probe
tttcaccatcgtgatggac

SEQ ID NO: 279 - DNA, 21 bp, artificial sequence
  ALK probe
ggttgtggaagcatgtgggag

SEQ ID NO: 280 - DNA, 15 bp, artificial sequence
  ALK probe
gtgggctagtgcatt

SEQ ID NO: 281 - DNA, 23 bp, artificial sequence
  ALK probe
tataccgattttcctatctctct

SEQ ID NO: 282 - DNA, 19 bp, artificial sequence
  ALK probe
gggtgtcagctcaccttgg

SEQ ID NO: 283 - DNA, 22 bp, artificial sequence
  ALK probe
acagaagtaagagctggttggg

SEQ ID NO: 284 - DNA, 19 bp, artificial sequence
  ALK probe
gctttccctctgccctttt

SEQ ID NO: 285 - DNA, 21 bp, artificial sequence
  ALK probe
cactgcagatccctttgcctg

SEQ ID NO: 286 - DNA, 20 bp, artificial sequence
  ALK probe
caggtatggcaccatatggg

SEQ ID NO: 287 - DNA, 21 bp, artificial sequence
  ALK probe
cgcccgtagtaaccatgcaac

SEQ ID NO: 288 - DNA, 18 bp, artificial sequence
  ALK probe
attagggttacctgagga

SEQ ID NO: 289 - DNA, 22 bp, artificial sequence
  ALK probe
ttacccgctatgtgctcagttc

SEQ ID NO: 290 - DNA, 19 bp, artificial sequence
  ALK probe
ccccgtgtaaagcccagcc

SEQ ID NO: 291 - DNA, 20 bp, artificial sequence
  ALK probe
aaggcaaactccatggaagc

SEQ ID NO: 292 - DNA, 16 bp, artificial sequence
  ALK probe
ccaatgtgagtgacca

SEQ ID NO: 293 - DNA, 24 bp, artificial sequence
  ALK probe
atgaaatgaattcaccaacataaa

SEQ ID NO: 294 - DNA, 19 bp, artificial sequence
  ALK probe
cctgccctgtttccctaac

SEQ ID NO: 295 - DNA, 22 bp, artificial sequence
  ALK probe
atatttggactgcagtttccct

SEQ ID NO: 296 - DNA, 17 bp, artificial sequence
  ALK probe
aattccgcctcttgtta

SEQ ID NO: 297 - DNA, 26 bp, artificial sequence
  ALK probe
ggggcgaagagccacatcatgaaaag

SEQ ID NO: 298 - DNA, 23 bp, artificial sequence
  ALK probe
agttgtgtttcctatagttggag

SEQ ID NO: 299 - DNA, 17 bp, artificial sequence
  ALK probe
ttcagtgcaatcacagc

SEQ ID NO: 300 - DNA, 26 bp, artificial sequence
  ALK probe
ctacaaggaattggcctgccttagta

SEQ ID NO: 301 - DNA, 18 bp, artificial sequence
  ALK probe
agggttctggagccaaag

SEQ ID NO: 302 - DNA, 21 bp, artificial sequence
  ALK probe
gggtaagcaccctgggtgcca

SEQ ID NO: 303 - DNA, 24 bp, artificial sequence
  ALK probe
ccaccgtgttgcaagtataacccc

SEQ ID NO: 304 - DNA, 16 bp, artificial sequence
  ALK probe
aaggaaatggggaggg

SEQ ID NO: 305 - DNA, 23 bp, artificial sequence
  ALK probe
aaagatgggattagacccaatat

SEQ ID NO: 306 - DNA, 15 bp, artificial sequence
  ALK probe
agggcagagtcatgt

SEQ ID NO: 307 - DNA, 22 bp, artificial sequence
  ALK probe
gaaatgcaaagctaaaaatcag

SEQ ID NO: 308 - DNA, 25 bp, artificial sequence
  ALK probe
ctaataaaatgattaaagaaggtgt

SEQ ID NO: 309 - DNA, 16 bp, artificial sequence
  ALK probe
tccatatcctcccctg

SEQ ID NO: 310 - DNA, 20 bp, artificial sequence
  ALK probe
aatggcccttgaagcactac

SEQ ID NO: 311 - DNA, 28 bp, artificial sequence
  ALK probe
ttgtcgctcaccgaatgagggtgatgtt

SEQ ID NO: 312 - DNA, 11344 bp, Homo sapiens
  misc_feature: CD74
atgagggccctgggcagccaatgggatcgtgctggcctttctacctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagaggtatgtgtgagcaccaggaaagggcacaccgatcctggactgcagagccgtgcgcatgtgctgggaagaagcaccggccaggagtcacaggaaagagggattcaggctctgactctaacattgactttttgggtgattttgagcaagtctttggcctgctctgggctccggctccctctcttgtcaaatgagggggttcctttaagagcaggagtttgtaactttccttgcatcacaccgcctccttctgaaaagcagaagagagcatgggttctctccctagagtttcacatgctatgcaggggctttgagatcccactaaagctgggctgtgaatgctaggttaaaggccttggaacaggctgtgcctggtggctcccgcctgtaatcccagcactttgggaggctgaggcgggcagatcagctgaggccaggagttcgagaccagcctggccaacatgttgaaaccccatctctactaaaaatacaaaaattagccagatgtggtggtgtacacctgtaatcccacctacttgggaggttgagacatgagaatcacttcaacctgggaggcagaggttgcagtgagccaagattgtgcaactgtaccccaccctgggtgacacagtgacactctgtctcaaaaaaaataaataaataaataaagaccttgcaccagattttgaaaatgttcaagatcccagtggagaaagagtttctaaaagaggatggtagaagcagttcttcacagaggagttccctcctaattaccacggatcaagggaatgatagttgcaggtgtctgtagagtagatggagacatctgccatcacaggagggattgtgagatgttgggggcaggcaagaaaggagggacaggctctggttaaatttctggagggggctcagggttgacgggggtcatgtccttgcctgtgcccctctcccttgcagccagaggccagcacagccatccaggggacaccaggcccccacttcccagccccaaaatagcctcacccatgtgtttccctcaaaaagggctagaaggctattaccccaatgcccctgctacccccagtctccaaaaagtaatttgcgatctacagggacttacagctaggtgtgatgtcagctgttgccaggcagaaaggggtttgggagaaccctgcagagatgttatgacaagctatgttctggggaacaaggtaacctgctgcagaccattagagctgtggcctgtgaaaaccccagggaatcccatggcaaggagggagactgttttgtgaggaatggattcaggtctaggccacgcgtgaccttggataaatcactgcctctccctgagtctcagtaataatataatagccataatagttctcatccactgtgtacctgtcaccaggcctcagccactgttagttagtactgtgattatttacatacgtaaaggctaaactcaattttaattcttacagtcaccctatgaatcaggtacttttgttgtccctttttacagaagaggaaattgaggtcatattggtaagtgacttacccaagtaatcatagctagtgagtggttggaggcagaatttgaaccaggactagtctgacatcaaagtgttagctcactccaccatttggccccctttcagaggtgcattttgtgggaaggggaggtgagacccctctgagctcagaccactcagtgatttacagacccaggtgggctcagtgttcagagtgcatgtccccttgtctaatccttgtctagttttccctttattcagttactgcttctaaagctggctatgtgtgcttaggccattccagactggagcctgttttggaggcttttgtgaatgcttctgcctggcaacatctgtgtcacgattcctgctagctctggttggctcctgactttggcttttttttttttttttttaattgcagaagaaggtagtgtaaatgaggaaataaagaggggggtgacaagagttggcactctaccagaaccaggggacaggcgttcaagatgcataaagaggaagaaaagcagatgctaaacttaactacgaactcccctgagaattgcactgagtgtaatttatttatagagtgctaacaatgtgctaggtgtggagccaagagctttaccctcatcatcttatttaatgtaacagcccttggagcagatgttttacccgattttactcacacagagggttaatcaacttagatggtcccagaactaaccgactccagagccaggattccaatccaggttatgtggtctcgtcttcagggtgaatctctaggttcttaggcctcctgaggaactgtggtgcagagaggggaaggtactgtcccatgtcgtgtgtgggaggtagagctggggctagaattgggtgtggggttgcagaagcactgaacaggtggaggatgaggctggagagcctgaacacaggctaggccacccgtgttccttgagaaggccaagaagtagaatttgttttcccttcctgtctggtctccccacttcccccccgccccccgcccaccgtcgggtttttgctgtttccttcccgaataactctcccttgggctgggccttatcccagaaagcacagactggcacgcagcaagccaatgagaatgagccagtctgtgatgtcatgagttaccaggcacaagggactcctggagcgtcctaaaccatccttgctggttgctggagtaggcagggtgcagcctcatccttgcagttcccaatgggtctgttttagtccgttttgtgccgctttaacagaataccacagactgcgtaatatacaaacaaacaaacaaacaaacaaaaaacacccagaaatttatttctcacagttctggaggggctttcttgttttttttttttttttttgttatgttttttgagacagagtctcactctatcccccaggatggaatgcagtggtgtgatcttggctcacagcaacctctgcctcccaggttcaagtgattctcctgcctcagcctcctgagtagctgggactacaggtgcccaccactacgcccggctaattttttcttttttttttgagatggagcctcactctgttgcccaggctggagtgcaatggcatgatctcagctcactgcaacctccaccttccaggttcaagggattctcctgcctcagcctcccgagtagctgggattacaggtgctcgccaccacgtccggctaatttttgcatttttagtagagacagggtttcaccacgttggccaggctggtctcgaactcctgacctcaggtgatctacctgtcttggcttcctaaagtgctgggattacaggtgtgagccaccgcgcccggcctagcttgctttcttttttttttctgagacagtctccttctgtcacccaggctggagtgcagtgacgtgatctcggctcactgcaacctccgcctcccgggttcaagtgattctcccacctcagcctcccaagtagctgggactagaggtgcacgccaccatgcctggctaagttttttgtatttttttgtagagacggggtttcgccatgttggccagactggtctcgaactcctggcctcaagtgatccacctgccttggcctcccaaagtgctgggattacaggcgtgagtcaccacacccagcctggtgaggggcttccttgatgtgtcctcatatggtggaaggcagaagggcaagagagaaccaactccttccatcaagccgtcttacagggcacctaatcccattcgtgagggagaaggccttgtggcccgatcacctcccaacaccttcacattggcaacacctggactagggtcttagtagtcccacccctggggtcgtcaaagaacagatcagaaactcctggggtgtaggggcaggatccttacatcccctgtactgtaacatatgcatgcaccccccagtcgcatccaagtcccacagatacaagggcttgctgaggtccgagggtctggatggtgagtccagggagcatgagaaattcatccaggccacacaggctcaggcacctatactcctgcccaccccctgcaggatggatattaccatttgaaatactttggcgcttgcagtgagatcttgcttaaaagaagaaacccaccaaattctagaatcgcagaggtgggggcacctatgtgacaaatgagggaacagaggcacagagattggcagggacatgctcaaagacatggagagcctgggcagaggatggccccagagtgggtggtgcctggccctgcttcagcctgacattgtccaagcctcccccagcccactcctaaaatggccaggccccacttcttcccaggtgggctacattttctgctgtcccggtcccacttccttaccttttctccttaaatctgatttcactgtgagggtgggaggttgggcagaggggtgaaaaccctcttccccttacttggtaagcacatacaattttttttggttttgtcaattaaaaaaaataacatacctggttgatcctgccagcagaaaaaaaaaacaaaacaaaaggctgggcgcggtgactcacgcttgtaatcccagcactttgggaggctgaggtgggtggatcacgagatcaggagatcgagaccacggtgaaaccccgtctctatcaaaaatacaaaataattagccaggcgtggtggcgggtgcctgtagtcccagctactcggagaggctgaggaaggagaatggcataaacccaggaggtggaggttgcagtgagccgagatcgcgccactgcactccagcctgggcgacagagcaagactccgtctcaaaaaacaaaacaaaacaaaacaaaacaaaaaccaaacctgttccccttgagggcagccctgatcatcaggagatccgcacggcaaagggagcctgggaagacccccccacctcaacccctcatcgcacaggcaggaccctaaggtccagagaggacaaagagcatgcctctttgctcttctctgttcaactcaggcccgtggcagctgcagggtctctgccagggaagacttcaggcacatcgatggttggaaggaggggtggggtgaggtcttcaagctgtgtttccatagccagcttactgtttgtgcttcaaatgcattgtttattaggggtggcttaggggtctaatggagatgggggtatacatttccccattcctagccagcccttggggcagccaccactgtggatcctcctctgacctatcctccccacctcccacagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcgtgcgtgcacccctacatcctgataccccccacctcccaccatccctcaactcagagacccgcatccctgcacccagctgggcccactgtcctctccctccggtttggaattccagcccttcctcatctgggtctgataccctcctccctgggcaccggggccacacttaccctcgttcctgtccccacagctcccaagcctgtgagcaagatgcgcatggccaccccgctgctgatgcaggcgctgcccatgggagccctgccccagggggtaaggacagccccagggtggtgggaggggcaaggttatcccgcctggatggaggacagtgccaaggggaggggcagggaagagagcccacctggggaggggtcctgactgctgcgggagggacagtgcctgcctcaggaagaatcgggctccccaggtgtggagggcacaggtgaagagtctcttggtgccatccctgggaggaaggctcagccctctacagtttacaaagtgcttctcatttcctatagcatctcactgtcctctcccattctcaaagaccttgctatcatgcattgacaatatttatattcacaatactgtgctgtggacaaaaccctgggcaggaaagcttatgccagtttgaccaatgaggacattgaggcaggaagctaaagtgacttgctcgagctctcatgtttggaggtggcagagatggaaccattgaccaagtgcctgcgattccagtctcttacctagatcccagcaaccggctcctgctccataccccctgctccagggaccagctctggtaaccttctgttacttcctcccacagcccatgcagaatgccaccaagtatggcaacatgacagaggaccatgtgatgcacctgctccaggtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgagataaacaggctcggctgggtgcagtggctcatgcctgtaatctcagcactttgggaggcctaggcaggcagatcacctgaggccaggagttcgagaccagcctggccaacatagtgaaagtctctactaaaaatacaaaaattagccggatgtggtggcagtcacctgtaatcccagctactcatgaggttgaggcaggagaatcgctttaacccgggaagtggaggttgcagtgagccgagatcatcacgccactgcactccagcctgggtgacagagtgagactccatttcaaaaaataaaataaaataaaaataaaaaaagaaactgaggctcaaagtttggaagtgacttgctcaagacaccctttttttctccccaaatttgtactgcgtgtctgtcctatgccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctgaagtccagggtttaggcttggtgtagctctggtccattcctcagaatggaagaccaagggaacgtgggctacacatttcacactgcctgccagggagctcttcttgaaccatccttcctgccctgctaccctgtagaatgctgaccccctgaaggtgtacccgccactgaaggggagcttcccggagaacctgagacaccttaagaacaccatggagaccatagactggaaggtcagcaggtttccctgcatgggaactctctctttcctctggtgtctagggcagggctaggagaggtggggtgagggtgggctggggaagccattctcaggaagctgaaggggtttaccagcacttccaaaacctggatgctgcagagtatgtggggttcagccccaggggtctttaagagggaaccaggctgcagctggacccgggtgttggggccctatttggccctgcatgtttctgtccccaggggcaaagccaggcagtgtaggggcttggtggtggccatcgaacctgacctccacctctatccgtattaggtctttgagagctggatgcaccattggctcctgtttgaaatgagcaggcactccttggagcaaaagcccactgacgctccaccgaaaggtacagggagtgggagctttagcgtgccagggcttctggaccctcggggctctcctgaagctgctgaggccggggcctccagcactccctggtcccagcaccgcggaatctcccatcctctcagctctcacttctttctcacttctctctctctcctgtctgttccttcttggtttggctgtccccctcccctgacccacccccatcttgtctaagggttcctaagggcccacagaggcctgtcaccacagggtacaggtgacctctctcatagaggatggtacagcacagggtgcctggggtagaacctgcccgaaacactgcagaaaggaatccttgtaatgaccttgccccagtgctgcccgcaatccagtgagggcgccaaggtcacagctgctgccaagagagccttgggcgtttcccacctcatggacaatgcagactaggatgtttttagacccaaagacagagtgctgtttctatcccggtgctgtctctaatttgctatgtaactttggacaagtccccttccctctaggattcagggtcctgaagtagaaggtcaaagggccaccctgcctggggcctcagtttctgcatcagattcatagaaggcaccttacatgctatctccaactcctagctgatgcttaaacccctctaagacatctccaacaaacggtaaaccccatttctacttgagaactcccagtaacaggaagcttagacttaccaaggtgcccattgcttttctctagaatcagaatcgcaagtgcaattccaaactgtaatggtgtttttttgtttgattgtttgtttttgagatagagtctggctctgtcgcccaggctggagtgcagtggtgcgatctcagctcactgcaacctcagcctcccgggttcaagcaattctcctgcctcggcctcccgagtagctgggattataggcatgtgccaccacgcccagctaatttttgtatttttagtagagacagggtttcaccatgttggccaggctggtcttgaactcctgacctcaagtgatccgcccacctcggcctcccaaagtgctaagattacaggcatgagccactgtgcctggcccaaaactgtaatgggctttgagtgtcagaagaaaccatcaacttctgaggtgaattggacacatggccattcacttcctttttgatctcagaccttgttggtctaggcctcagttttcccatccgtgtgatggctggagtgagtaaagccacttgggaagaaggcattaagcccacagcagtggtgtgtgggtctttagctctgctcagaccctggttcagagctcactcactcactgtgtcctcatcatgcctgtcgcttcagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtggtaagcagtggcactgtgccagtgtcagaggaccaggaaggactaggaaggttgaggggcaagaggtcccctctgaagcacatgggaccaggacacccaggatggcagctcctgggggcagtgacgtagtcatgcgtccagccctttatccatccacccacctgtgcattcctatttgtccatttatcatctctcctcttacatgcactcatatttgttcacttatccgtcagtcctttcatctgtgaatttcatccatccacgcgccatcctctagcatccaggagtcctacagacccacccatctcatttcatcacccccttctcactcgagcccccattacacctctttgttgctgcttgcagctgtccttccctgggtacctgctttcccaggcactaagcctgtggctaggtgggaagcactgccctcaggcatcttgggtcaggtaggctgcacttcaagtgacaaacggacttgctgctcctttgcagagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 313 - DNA, 53684 bp, Homo sapiens
  misc_feature: EZR
ggcgtggtcccgggacccgccccgccggggcttttgggagcgcgggcagcgagcgcactcggcggacgcaagggcggcggggagcacacggagcactgcaggcgccgggtgaggcgtgcggcggccggggtcgggacgggggttctgggcggggggttcctggtggagggcccgggcgggcggcggggttcggcggcaggtgcggcgggcagcctagggggcgcggcgcggggttctcgcccggcacccccggggcaggtggagctgagccggcccgcggccccgcgaccttcccctcggcgccgggtcccctcaggtctctcccgaaggaaacgcggagcctgggtgcctgggcgccgtccctcggcggctcccgagcggttgcagtttttgaaagagtttctcaaaggcttgacggttgtgactgcagccgcggggcaacggttgctacacaaagtgaaacttgccgagtgctcggcttctcacgggcttcctggcagccccgggaagttcctcggcggaccccgagcccgcgccccctctccacggatccctccccagcgagtgcccccccgcccgccctgtgccccctctcccctgacccctccctgtcgggtgccccgcgggctcgcgctggctgtcccgggactccttcctcctaggtgttcctcctgcccctcgccctctctctcccaggcgcgcgctccctctccccgggcctttccccgccgggtatccctgggcccgcgccccctcttctccgcctctctccgctgggtgcacctcgagtgtcccccagacccctccccgcccggccggcgctctctcccctgaccctcctggccgagtgttccccggggcccgcgccccctccccccgatcctccccactgagtgttccccctgccctctctctcccgggcctgcgccccccaccagccccttcatgctgggggtcccctgggtgcgcaccccctctcctcggacccacccccaactggggggcacctccagtgcccgccggctgccccttgggcgcgcgcccccgctctcgggcgcctcctcgccgggggcccggcccggccccgccccgcccgtgccccctccccatgcccgcagtgctgggcggggcgctgactcacccgggcccgggctggccggttcttaagcggcagcgcgctgcgggcgccgagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccagtaagttgcccagtttctgggccgggcggacgggagaggcttcattggagaggggaggcacctgctcgaggtgttggggcagttcctggggaacagggttcttctcacacgcagaagacgataggaataggaggaggttttcgccgctctttgttacttgttgacccttttgtggagcgttaggaaaacaccattttgatgcttttctctgcagtctttttctttgtgagccccctccccagtagttacggtcttttctaaaaactagaggcctttttacactgcttccgtctgtttttaaagggtatagtaatacaacttagaagtttcttaaaaagtccaaatcacagggagactcagatggcttccgaccacacacaccagttctcagagctcctaagggtccgaaaccacaggcgccccagatccaactggggagatattaaagggcgtttgggagaggagactggctttcggaagttgcctttcagcttcgcttcctactaggcccatgaagcggtgccctgtacaccagcaaacttgctggctgcagcagaatttctgtctctaacagaaggttagccatggacttgaattgtagatgcaggcagccggtggagtttgataagaggttcctggcaggccgggccgagcactcctggtcagctgatgaaagggctgtgcctgcgcctctgtctccttgaatctgattgtgttgagattgctggcgagacctgggggttgtaggcacaaggcaggttctctgggactgacgcttcttagaaagttgtatgtattctacctgcttttaacactggggaactggtgactagacattagggggaaggtttaacattttttgagttttgaatcacaatggacaaaatatcaggattcattacaaattgggattacagatacatctggaatttttttttggtttttcaaacaagttggttctgtaatcaatgcttgtgtgccttttgtgggggatgggggagcggagtctctctctgtggcccaggctggagtgcagtggcatgatctcggctcactgcaacctctgcctctcaggttcaagcgaatctcctgcctcagcctcccgagtagttgggattacaggcatgtgccaccatgcccagctggtttttgtatttttatagagagggggtttcaccatgttggccaggctggtctaaaactcctgacctcaggtgatctgcctacctcgacctcccaaaatgctaggattacaggcgtgagccaccacacccggccttgtgtgcttcttctgttacattttatgttctctaagatctttgttagaggtattaattttgctgttaggataaagaattaatatgccagtagattcagaagccaatataatttttgcctaagttacatcaagatgattcatttgtgatgcagagtattttctatacaaaatttttctttttaattcaaacttaaaagtgacacgtgacatcgaggcttgacagtgcatgtggtatgaaactgacctaagtacaaccccttactcaggcagagctgagtgcaacggtatgcggaggagtggtcaagaagattacccttctgggtgtggttttctttatttcactaaaagaagaggtgcagagctcagctaagatagcactcaggaaaaagttaacctgttctccgtcactacttttctttctcatttctcataatgaatggtaatttatttttatggtttcttttttgtattttggtaaaatatacagtttatcctcttacttttaggtttacatttcaaggtattaagtacatttacattgttacatagccatcaccaaggtccatctccagaactttatcttcccagattgaaactctgtacctattaaactctccctccccatccccaccaccagcccttggcaaccaccattctactttctgtctctatgaattcgacaactttagatacctcatgcaggtggaatcgtgatagcatttgtccttttgtgacagtctcatttcctgtagcataatgtcttcaaggttcatccatgttgcaatgtcagaactcccttctctctcttatttcttatggcaggtatgttttcatttcattttgttttagaggtcttttatgatagatcagaacttaaaagatgtttctgacatttgataaagtgaagatagttgtgaaactgttaaggaaagacagtagccatcaccttgtgtattagagccagagttactctttgaaagactgtattctgtataatatctacaattaaaatttttaaactttttttgaggccaggcgaggtggcctgattacaggcacgagcctgtaatcccagcactttgggaggctgaggcaggcagatcacatgagcccaggagttcgagacttgcctggccaacatagactctgtttctacaaaaaatagaaaaattatctgggtgtggtggctggcgctctgactgaggctgaagtgggaggattgcttgatgagccctggaggtcaaggctgcagtgaactaagatcaagccactgcattccagcctgggcagcagagtgagatgttgtctgaaaacaaacaaaaccccttttttgagaggcttccttttaggtcagccatacctgtctgccatgggaaatttctccctgccccctctttggcagaggagggtcttagagataagttaaacacactaagcctttctgtgtgtaaattatattagagccatcccacaaatcactgagaagagcatcgtaggttgcacatatttgaatatgacatttcttaaggctgttagagaggatccagttagttttggtttggtttggggtttttttgctgccttagtaaatgttaaaatgaaacatccaccaacagctctgtggatgtgtcctttaaacaaaggtttattgattctaattattcaagcctaagttaagaatgttagcgaagaatgttaggtggttttcttgggcttaatgtttaacaactggattaaggggcaaacacacttaaaggatggatacctctgagtagttggccttccacctgattcattgcaactgttaacccttgaattcaacgggcaaagtatttttgattgatttgcctgaactgagtgagtggatgactttattcataaaacagtataactgaaaatactcatttcctgtgttttctcctaatactgtttcccaaaagcaacagttacttaaaagactgaggcggtacacagtggctcatggcagtaatcccagcactttgggaggccgaggtgggcggatcacaaggtcaagagatcaagactatcctggtcaacatggtgaaaccccatctctactaaaaatacaaaaattagccgggcgtggtatggatgcctgtagtcccagctacttgggaggctgaggcaggagaatcgcttgaacctgggaggtgaaggttgcagtgagctgagattgcaccactgcactccagcctggcgacagagtgagactctgtctcaaaaaaaaaaaaaaaaagactttattcatcagcaagcggagtgacctgcacagagggcgaggcagaccttgttctctggaagcttagtgtctggtacctgggccaagatgcggggtaaatgctgaaattgaaaacccgctaagtgctgtcagactgggaaagagcctaggtaacgtcgagaggaaaatctgatggggaaaggaaaatcatctgatggggaaattggcagactgtattgagaagtaacacttcagctgaatcttgcttgagggctggggggcgcacgcggcagcactccacagggaggaacagctgtggtttgttgtctggttttgcttttcccacagctgcttagggactctattcatgtgtgactggctgacgtccaaggagggtgatttggggttccagagggagccttggcctctgttcaggccagtccccaggacatggtgtgctgtgtggccttgtgggtctgccccatctagggagagttgtaggagttggtgctcagatcattggtcccggaagcatcctctctgcccgccccttcatgttagggtgactgcggagcgcctttctcccacacttgctttcttctgcccagtggaaagaaggcatggggagtgagcaaggaacactgctgtagttaagctctggaaggaaaaggggattgtgttcagggctgagatctctttaagctgtcatgagaaccatagagctgaactgcctttaagtggctccaacacatcttacctgttcatttctgaagtgttatagacatttctaatacaaaagcaggtttacctttcattaggaaaactctgaaagtgtgttcacatttctactgtgccaaaattttaaggtaatttctgagattaccttgcctctttgggaatacataaccttttctattaaatattttaacagggacagtttactgaatgtactcccccctcacaatcccctcgcaattgaggaggatgcgtagcatctgtttccacccctcctcctccacgaggggcagtggtgaattaggtagctaacattttgccatgtggcagtgagaggtgctggtaggatgagtgatttgccatgatcacgctgtaaggcacaatgaatgtatttggatgttcacagacacagtccctgtcagtggatttacagtctggtttcggggacagacagcaatcccagagtaaatgtaaaactgcagcttcagagagtatgcctgaagaggggtacatgaggcctgagagtagatgaagtgtgtatgtgctggtgggggtgcaaataggggaggtcaggaaggcatccttgaggacgtgacctccctgggcagaggtaacaacgtgtgcaaaggccctgtggtgggaggaagtagtgtgagtttggggtttcacatgaagcccaatgtggctagagaggaagacaggtcaggccatgccttgtaagccattcttgggtgttttttagtttaacttggggttttgactgggaggtgacatgatcagatttgccttttgaaaagttgactgtgatctgtaataggaaaatcacaggaggcaggagacagcaagggtagttatggtagaccattgagggagctcatagcttggaccaaggtggtggtggtgggaacagaagtggatgcatttgagagttctttgggaggtagaattgatagtgcctggtgatgggttggatatgcagggccaagggtggtgtcgaggctgacttctcgtttctggcttgcgcaagtggatgtgtggtggtgccatcgctgaggtaagtaatcctggagaaggaccaggtgtgggggaaggtggggagtctggatttgttgttacatgttaataagtttgtgacaatcgttgatgaaaaaagtccttgccttctttcattactacatccactgccccccaaaatattaaaggaccagactccttaaactacgttatttttaaatccaaataattcagtagctttttgttttccctagtatatgtacacaccgtacatacctaaagttaagaggaagggttaatttagtgcagtgttctcaaaattttgtgtacacaattgtctggagactgttgattcctgggtcccttgaagaactaatgacttccatctctagggtgaggtgcaggctgggtgcttatgttttaaataagctctccagatggtactgctgattcaataggaaaagggcagttattatatattcctttctcctgcaccccaatcaagcccagtgtgatttcagagcacccatttgggtgaaagcagtcacttgatgcccagccgccttacagtccggctgaaatgccaggagtgctgttattggtatttgggactcgaataggggctaggatgactctgtgaaaaagagccataaaaacaagaatttcatagctaatttactgcttacctatacttgggcaggccattcaacataatattcttctgacttgagtttctctctgcagggagtccagtaacagcttcatttggcagtgcccagtggtctctcacattttggctctttgttttcaaagagaaaaaaagaggctagaccttccctataaatggtagggaagtaagagatcccattccttgttcctcttttattccttccacactggcctcttttgttaatgaaataatgtgaattttttttttttggaaacagggtctcactctgtcacccaggctggagtgcagtggcacagtcacagctcactgcagcctcagtgccccggcccccacccttggctcaagtgatcttcccacctcagcctcctgggtaactgggaccacaggcacacactaccacacccagctaattttttatttttttgtgaaacaagatctcactgtgtggcccaggcggctagtctcaaattcctgagctcaagctatcctcctaccttggccttccaaaatgttgagattataggtgtgagccaccatgcctggctgataatgtgatttctaacaaatgttgaataattatagtttgggaaaggaaaacagtatcatttagtgaactataatttttttcttaatttttttaacttaaacttttatatctctttgacaatttggagattcttagggtggtttgatatacctgctttctaatggtagttagatgtttcagctctattctgaagcagtgaaattcagtctgctttctaatggtagttagatgtttcagctctattctgaagcagtgaaattcagtctgctttcaaagtcagtgaatgcattttgaattatcccttatttcatttcagtagtaactaccttgagactccccaagtactccaattagtttttaatttcagcagtaaatgtgtgttgaaaagaccaaagtttgcattattttccttctgatgtatttaccatccatgcctgttgacataaaaagatttttccagacttgggtagttttcagaaccaaacaaaacccttgtgctataatgtgacttagagacttttgactgaaatgcttgatatagttaatacacataatttttttcaaaatgaaaccacaaagagctataaagagaatttcatagctaatttactgcttacctgtatttggggaagccatttagcatctgtgaacctaaatttcgtcagccgtaaaatgggagttagtttttaagtggaaagaatgttacataagataaacggagacaaagtttttatcagtgaaatccaaacaactcatcttaagatgctgtaagctttatgtgtttcttttgtgtttccctaccccgcaaatgtttttcaaacttaaccctgttaggtaaaaactctgggttcctataaacgggtaaagtttgtccattggtcttctcaaggaaaaagcaatatgaacagtttgggttatcttagtaaaagggaggactctgattttgtctcatgtccatcctctctctgtgtgttctagtcggaattcccttatcagtcacatgggtaccaccttcatgttttgaagcgctattatatcccattatgtgcttggtgcagggacaataaaaataagattggttttgcctttaaggagttctcagtctcctagtgaaagcagatatgtaagcaattacaatgcagtgtagtgcatgatagaggtcttcacagaagagaagtgtgccctggagaccagggagggcctcccggctggtaagatcctttgggtaagtgtggagggatgtgggcttcccagtcagcagtggtcagttctgttttcctttattcattaacccgttcttaacacttacaggcaaacagtaatgctgtttcaaaggaaatgtaaaacttcattaagttatccttttaatctaatatacttgaaaacaaaaccttaaaagcaaaataaaaaatatctcaccatgacccaccttttattgataggagaggaaccagtatcacctgaggatcaaactctagtagtcagtatatcagattttgctcatatttttaagttagaagtcacttctgcaacctaattttgttttccatttttgcctgagagatcaattttaaactgcctgtgtggacagttgtcatttcagatactgtaaataattgtttttactttaggatggggtaggtaaactatcatcttagggccgagtctggctgtggcctgtttttatttggtctcccagctaaaaatggtttttatatttttgaaggattttaaaaacaacaatatgcaacggactccaagtaagaccctcaaagcctaaaatacttactggctggctctttagagaaacaaatggaccaactcctgcttctagcataaaaataattattgttaagcatttattctaaccttgtatatattttatggctggactaatatttggaagcagatccaccccattggttccagtttttaaaaaattgttctcaaagaacagaatgtgttttgttagccaatgttgagcacatcatggactctgagcatggactcagaaactactgaggagaggcatcgtggtgctgaggtaatgttttaaacaaagctggtgtttgggtgggtctttgtgtagagaaagtggcagtatcttgtgtcacacttgctaagctattgtgtaatgacagatttctggcatatgctaaaagaaagcaatttgtacctgatgtttgagttggaaagagaatgttatgtaaatgaattgcttttttcctcattgatagtttaaaatgagcttttgatctactatagtctgtatgtgaatttctgactgcagatgttttgtaagtccattcctgattcagaacaccctgtctaaagtacagctccatctctgtgccgtgccccactttactgcactcatagaactcggtctccacctataacgctgtcaggtgcttgtttatttgtgctttttgtcttttctggcagcaaagcaagaggataggtgttgtttttgtgtttttgagatgcggtcttgctctgttgctcaagcacgagtgcagtggtacaatcatagctcaccacagccttgaactcctgggggaccgcaggcgctcactaccacacctgactaatctttttatttttatttctatagagatgaagtttcacactgttttgtgcaggctggtctcaaacacctggcctcaagccatcctcctgcctcagtctctcaaagtgttggcattatagccatgagccactatgcctggcccaagtttgtttgtttgttgtttagcattattattttatagcaaactttaaattcttgtttattggcaggataaatagagggaagaaggacgagcaaataggtaaacatacctgcctcctagtgggtaatcttgggcaagttttttcacctccctctgcctcctcatctgtaaacaagatcctgcgtgcccgcctgggatgcctgctaagatggcacatgggaagcacctggccttatgcctggccctggtcagtaagggctgtgcggttccacttgtacctgataaaattctaatctgattaaaagctttactagctcgtgatggtcattcttttcctctaacttagcagcccgatgaaataatgtagtaagtaaatgtaaccttgttgtttgtccttttgctgccacgatgaacacagctgtcttgctagacctctgttgacttcaacagggatagcatcaggtttattggaaatttacatatgggacagtccagtggtggtgggttggacagaacagcaactgcttcccgaaagcttggaaaaagcatgcagtttacacagcattcttacttaacatactccccctaacagcctccacctggcagccttaaagtgcttgtgggctgggggttcagatgttccccatagataaggaattgatttcagggttggccactaggattccttagctcggaactccacacacgcattcttcttaagttattgatgttaggtacacctgtacaaccaccctgcataaagttcattcattcaacaaatagagcacctactttgtgccaggttttcaggtactggggagacattggtgaacaaaaagaggcttttaaaggattatcacctgcttggttgacagtcacatccagtgaatggtggaacccatttcctgctaatgtgtatttgagcctgaaatgcacattgtcccacctttcctcaatggcaaaatgctctggaaaggagatgctggtctgactaaataaaatgggctttctgtttggagttgtaaagggagccgtgccttcctcagcccctcctgaaagaaagacctgctttcaagaagcttatattgcagggggaaagacacatgtctaatacatcgtcagggggtggtgagcgtgctactgtaaattttcacctaggctttggcaagagctagaattaactttcattctttactgactctttgaagcgttaaaaccactgggcagagtgacttaggagtgggcccactgtgatgtgtttttgttggttttctggtaaatcacttttgggttggacagtgaaccatgatggtctttcttcaagaacttgtttttgcaagggtttggtgataagtccatcatttccaaacccacttactcttccatcctttctcaggtgctgtggttcagggaaatgattgttttgatagtattttacctattgcaccattacttcatctgtaaatttcttataaaatatgtcttgggatccagccttgtcttttttgtttgttttttttttttttttttgagacggagtctctgtctgtcgcccaggctggagtgcagtggtgtgatctggactcaccgcaagctccacctcccgggttcacgccattctcctgcctcagcctcccgagtagctgggactacaggcgccagccatcacactcggctaattttttttgtattttttagtagagacggggtttcaccatgttagccaggacagtcttgatctcctgacctcatgatccgcccgcctcagcctcccaaagtgctgggattacaggcgtgagccactgcgcctggcctgttatgtttttaaagagaaaattgaaccacaggtcacttggttaaagcttagcacataaatatgagattggaatcactttatttgtaaacatatatgtagtgtatattggtacagtattttcattaaggtgtgtttcattgcctcagttaaataattaagggtgttggctgctgggatgttgaagtatttgcttacataatccattgctgtttgggtgagactcttaaatggatttagacagataatggtgagaaaactggattttttatttagaacgtggctgaacaaggcaatgtggaaatagtgtgataacaaggtgcattatataacttgaacaaatcaactgcaaaaagacattttcaaagaaatggaggaaaattgaataatatttactgaacttgacgtattaaggaattgttttaaattatgttggatgtgataatggtattgtgatttttttttttagtgctttagagcaatatactgaagtttttacaagtgaaataatgaatgagggccttaaaatatgccagcaaaaaaaaaaaaaagtgaaagtggtagagtagaagaaagaatggtgttgaagctgaaaagagagtgtggaggatcatggtactacttattctctctacttttatgaatgttttcaactttccataatagaatatttgcttttaaaaagcatgttatagggtagaaagggagagatgctttacttttgctcgtcatgaagtgcctgagtgttgaggtgggaggatctcagggcgagggcaggtcccccattccctgctgctggggcaacctttgtgctctggatcaaatgagtaactgatttgatctcatcaaatggccccacccgggccatctcaccctccatgcacatgttttaaaaggaggtcactactcaaaattgcagctgacttggaaacacatagaacgatttgttcccagttttttccactattactttgtattcccaatgttttggggggcccataggaatggggcacagtgctgtgacccaactgggaacaggtcattgtcttaatagcgattttctcagacttgaaaattgaaatgaacaaaataaggggcatctactgggtagggctttagccattttaagagatcaatctacatactggggctgtgggcagggatgggggaaggaaatacagcaaaccatgggttggggttggggtgagtgatagggttgtaaaatgtacaccatgtcttttccagtcaagtaatgatgtacaaattataatgccatttcagatgtaacatacttgatactgacagtataaattgaagagtttttttaattttaatttagtataatttcagaaatggtgattttaaaagttttggcagggtttgcttatttaagcaaattttgtaagattactgatttagtttggattttttaaaagaagctactttggtcttgctaatttttgacacatggcaaaagtaaagactggggtgagttcaaatcttgtctaatcgaagtttcttacaggagaaatgttctttaacattgtataatattgctcatgtgatcttaactaggggcaaaaatttatctcagcaatggcacaagacttaagtatggtttatgtcttatgtcctctaaaaaacaggttagcaaagaaatttttcgacctttttttttttttttttttttttttcctgagatggagtctctgtcaccaggctgggagtgcagtggcgccatgtaggctcactgcagcctccgactccctggttcaagcgattctcctgcctcagccccacgagtagctgggattgcaggcacacgccaccatgcccggctaatttttgtatttttagtagagatggtttcaccatgttggccaggatggtcttggtcgcctgacctcgtgatccacccacctcagcctcattgtttcctagactcaccttctcactcccaagatcagaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaaaaaataagaaaaaaagaaaggaaaaactcttcacaggcttctaaatttgcagagacaaccatgcattccaggtgaatagtgatgtttaatctataggcctttagttccctatcttttctgagcctacaattaaaaccgactctagcatataataagccatcttggccttgtcccttacttttgtttatgtgtgtagttactaagtttactaagtagttactaaacttaagtttctgtgtataattacctgcacatttcagtgaagcatgttggtgatgaagtatttatgatatacctagtgaaactgaaatcacatggtatacaatcaagacttagacttcaggagtttattagataaattcttgttcaaggtccctttctctttattttgcctgccctgaggtaaggagatgagaaggatgtagattgtgtttctagaaagaatagtttcttttgctgaatgtaacatcctttgattatttcttttccctttcttaggggaaagtggtgtctaagaattccagtttacttccctgttagataacacacaatgtatgttatttccagtgtagaagaagttggttcttaattagagacactcaccaaaaagggccttaaaaactagcagctaataggtatcaggagcattattttcatacgccatcagcaggtcggaaatggccatcagtgttactcggcagtgcaggcttggaactcgggcatgactagcagtcatttcattgtcagacctatggaaagcagctcctttctgcctcccagatgcagtggacagtagggagggcttagcacagaactcttcccaacctggttttaaaatgaccctcttttgaatgtgaatgcccagaaagttcccttctagttctaaggtcatgattttcttgctgataataatgagcacagatgggactggtttgtccgctttttgtgtttgttaagcagccttggtctgacaggatgtgggtctaggggcaggaagtggcttactctcagaggaaaaaggagagctatttaggatttgagatttcattacatgttcttgaaattatggggtggctattattctggactctctctgtatattttatatatatatatgtatatatatatatatatgtatgtatatgtatatatatatatatatatgtatatatatatatatatatatatgtatatatatatatatatatatatatatatatatatacatatatatatatatataatgttacataatatttaccctggagttggtaaatacaaacttttcaaaagcataaaaccattggcatctatttaaagatactattttaggagtaatgttaaagagccagagctacacagatattttggtagctgattaccagaagttgagggtctcagtttttgtaaccattaaaaaaaggtcatcagacgaggataaccgtatacctcgtatcgagtactcatttggagtcactctaccagttatacttcatcactattctgattggctacttaaaacatacgtttatataacataaaaatgtaacatcatgtagatacgtgaaaagtcagttactaggaaattcccagcccccacttctgtgtcaatactctgccctgttaacgtctgctgcacattaagaatttagccttgacattttaagtttagcctaatggtggtgctggaggaagtagtaaggagaacagtttagaaaaggaggtgtgagtggcatgtagtgttacttttcatcatttaaattactcaaaaagttccttaaagtgcttctggcttctctgggaaatgagttcctgcttccctgtggtgtcaggagaatcgcagggtaggagacacggcccctaggatactggacatgggctggatgctgtattcgagggataaaccatgtatggttcttgtgcttaaataagcaaaaacctggccgggcgcggtggctcacacctgtaatcccagcactttgggaggccaaggcgggtggattacgaggtcaggagatcgagaccatctaacttaacatggtgaaaccccgtttctactaaaaatacaaaaattagctgggcgtggtggcacatgcctataatcccggctactcgggaggctgaggcaggagaatcgcttgaacccgggaggtggaggttgcagtgagccgagattgcgccactgcactccagcctgggcaacaagagtgaaactccgcctcaaaaaacaaacaaaacactaccaccaaaaacctaactagccatagtcaagtagaagtatacaaatattccagaagaactaaactataaggtgtttgtaaatatttagatgtgaatgagtataaacaacgcatcaaaaaatcataaaaattgatatttggtaaattttcctttctgccagacttgctggcagttaaaatttgaaacagtgactgtaccgaaagcctttttattcaggttaaaagttgtactcccatttcctaaaataaggactgaactgagaaactctagctacagctacttggttttccatagagttaagttggctccttagatgctgaagtctgtagttatgaccttgctttcattagtaattagcacctgggcaggtactaaccaatgaatgccctttacacctggcaagaaggaatgggtggggaggccagattgtttcaatctaaagggcactacgttgtggtgggttacgttttttggtagacagacactgcctacaggcaactaagtcattccattaactgtcattatcaatccatgtgtggccaagcttgaattgtcctgctggtttagcttcctgatggggaacaacagctgtcgcaacgcacagtgtctgcagctccatcatgggccccaggacgtcccacagcagctaacactggtctgtactcggaactctgccacctggccagtgacttttgtgcgtcatgttcctgggaatagtatgactgtccatgattcctaggaaagctagaggaataactgaggatgaggagctagcactttgacccctgtggggagtgctggttatagtggttatcagggttgtgacaagtggactcttgtgagttccaacactggatgattttattattcctattactcaggcagtaaaagactagtacatatcctggtgttatataattatatgaaaacttatcagaatgagttttataactagcgtacccatgtttttgttattgtgctgcagataaaatggcgcactgaaatgttactgaattatgtgacaatttttgttacaattctgtgcactttttacaagatttgtggagcttagatagatggctggcctttggcatctgaacattttcctgagcccgatagacaagcagattttttttgtttgtttttggagacagggttctcatgcctgtaatcccagcaccctgcctagttcaagaccagcctggctggcaacatggtgaaaccccgtctctaccaaaaatacaaaagttagctgggcatggtgatgcacgcctgtaatcccagatactctggagactgaggcaggagaatcgcttgaacccgggaggtggaggctacagtgagccgagattgtgccactgcactccagccttgacagagcgagaccctgtctcaaaaaaaattaaaaagacagggttctgttacccagtgtggtggcgcaagcatggctcactgcaggctcgacctcctaggcccaagtgatcttcccacattggccttccaaagtgctagggttacaggagtgagccactgtgcctggccaagatttctttgcctttgcgctcatgttcttctttaaccttaaaagaagaggtcatataaaataatcaggtataatttaagatacagaaagcttgatagaaaggagtagccgtgttctacatcttcatccattgcatttgcagatatgcctcaggattattttattagtacaatttttttttctttttgagacagtctcactctgtcacccaggctggagtgcagtggtgcaatctcggcacactgcagcctccacctcccaggttcaagcgattgtcctgccttattccctggtgtatctgggattaccaatgtgcaccaccacacccggctaatattttgtatttttagtggagatggggtttcgccatgttggccaggctggtctcgaactgctggtctcaagtgatccacctgcctcagcctcccaaagtggtaggattataggcatgagccaccgtgcccagcctagcgtcatgtatttatactgttatttccacctcctaaaagtcaacaaggacacttagctcaagaaggctgatgttgagagagaacgcttatcagaacagggatctctgaggaaaaagggagcttaaatgtgtgtccctggaatttcttctagcccttcctttccttggtgacatggccactgctatgggcgggaattagagaagagccctgaccagtggtgttgatgtctttgccaagtatactgtcaggtcagtgtcataaattgatgatatatatagagagacttcatttaatagaaaataatattttaaggaccaccttgctattttacttctctaataatgttttgaatattttgataaatacctttagcaacatagtggttctcatctcagccctctctgtccttgaaagaatgttatttataacagggtggtttctggactgcccttctggagtaaaacttgggcattctaaccatatgcttgctggaaaccataataatgtaaaaagtcgtcattgggttttcaattgcaattacattgatataattttgtatataaaacagtctgttactgggagcagcattgttcatgtaagaaagatgttcgcttcatataatacatggaaacaaagttatattttcaatgttagccattactgtgacactccaaaaaaggctggtgatggggagaaagaagagctttaaaaaaacctacagacaattcacttgcctctcgggcttttctgctttgcctgccttgaccgaattagagtatctgcatttctgcactaagctggttgaggtttgctaagtcaatggtaatgttttacagagcttggctgttagccagcatttgtggaaaacgaccaatgtctgtcatagctagtgctataatttattcagttggcatattgtttatggagacagtgagataaggggattaggatccagagagactattaaaatatgtgagtccatctgttgtgatctgaggtttcattagagaaaacctgtctgctagtacaacaaatggagacttagtaaggatgtttttatataaaggattataaatcagcagaggtaaatacattaatcttggccaaacaggtcatgtccttttgcgttttcctgatggcaggttctgccccctgccgcccgggcactgttggtcatagcgtgaccttggcatcagctgtgagccggtaaacatggaaatgtaggcccctcccaacctgagtcagacccttagcctggggtccaggaaactgttttaacaagcccctgggtgattttttttcacatgttcaagtttgagcgcctcgagggcctgtgaatggctgcatataaggtacagctggccatatgtcttaaatgacttcaaaggggtgtgagccaggcctcttcccacaccagacttcatgaaccatgcctggtattgtcatgtttttgtgagcagccgtgaatagggctgggggagagagatgttcagccaagaaagtctaaaatagaaagggaatgttcagttataacaaaacaaatttttgtaattagagtgctgggttgtgctcagcatcattggagttaaatgtggagcagtggcttacacttgtaatcccagcactttgagaaactgaggtgggcggatcccttgaggtcaggagttcgaggccaccctgggcaacatggtgaaactccatctctacaaaaaatagaaaaattagccggctgtggtggcaggtgcctgtggtcccagctaaggaggctaaggtgggagaatctcttgaaccctggaggcagaggttgcagtgagctgagatcacgccactgcactccagcctgggcaacagagcgagagaccctttctcaaaaaaaaaaaaaaaaaaaaaaaaagcggagcagcaaactaagtcccttttccatcgagggaggtctctgaagcagagctgagccagcctctcagctctgccctggtggggcaccccatagcgcccagaagcagtgagggctaaggcggcagagtgcagcatggccatgcatgattggagcgccgctactgtgttggtgtcagtttggcagccagcaacttctaagaacatagaatattttcatttagaacttaaaaacagtaaacccaaaaagtttagtttttaaaaattcattttgtttctccctaaagatttttattcttttgaaaatgaccacagtctagtttgaatgccattgtttttcagctgtttcttatttgcaattgctaaaagcaacaaggagcaagttaaatgtccatcacctgaatgggtagacagaagtgacagccacacaatggaatattcctgggcagtaaaaaaagaatgaagtgctggtacatgctacaacatgaataacccttttaaacattatgctaagtcatgggattcagtcatgaaagactgcatattacaaaattctgtctctctgaaatgtccagaataggccattccttagagacagaaagtagattggtggtttccaggggctgagggatcaggaggaatgcagagtgactgccagtggccatggagtttctttttgggctgacaaactattccaaaactagatagcagtgtcagttgcataactctgaatatactaaaaaccactgaattatacattttccatgggtaaattttatggtaagttacatttcaatagctgctatttaaagtacatagtgactcaacatgaaaggaaaaatatacagttttgtctctataattacccaattaagtgaaccaaaatagctgcaaagtttttaattcatttatcattggttgtaagaattttccctatcatactcccatttgtgggagaaaatttactgtatctactttctatcagagcatttctaagtatttgaaaggtcttatccaaatatttgaaagctgttaaaagttgctgaagtggcaccttcggaagaaggctggaatgttggaaaacagcgttgacattttaaatgatatggaaggtcaagctcgcaatgtaatcttggtggtggctggatggctctactcagactggtttttgagtaaatggcaggtgtgataatatagggattaatctgttaaccactgaatccactgcctgaaattcagacattcaaatgctcccatttgaatttccctttcttattttacatggttttcctgatttttgagtacataaaaaaattattgcaaacttttttcctgcagtgttctggccactgaaattaaatctggttcttttgtctaagactcaagggttgctctcctgtaatgtttgtggaggaactgatcttggacttttccctcctgtcttgggcttttattacagtttgaatttatgctgtaaaaagtgtgattgtagaggtaacctataagtttaaaatattcagaggaaatggatgcttcccaaaggaaaaattgcatacctatatttatttaccaaaatgaggaaaatacctgggaaataatttggccaaatattcagcaattatattcatagattagaagcaaaatacaaaatttgattgtcaacttggtacctttttcattccttacactcttagaaggcattttaagatgccattttgataaaattaaactgggaagactcagaaatcatgttttcccaactatattctgaaaaatcctagttccctgggatgctccgtggaaataacctgtgggcagaacaatctgtgaagtggagactgtggccccgtcttggactgccactgttggcatcaacatggcagacaggcaacagcctttcagctaaagaaggaagaaacagaaaaccccaccttaaccactgcagagttacgtgacctccaaacactgcccccacagcatatccccatttttgtccctttccctttcaaagccaaataatttcaaagaggactacatagctgctggcttgggatggtgtcaaaagccaggcaagatgattttaagtcatagaatgatcgagctggaagatgctcacagattaaatggtctccagccactcaatatcagcagcaagggagaggaacagggttggcctgagtgaggctggggccacccctgccgccaggcctgtgtgccaggctcaggtgctccagggaatgagcaaagaggatgttgggtttattttgttttaataaggcgaattgttactgagtttatttaaaaataaagcagcttggggtttaacaccttgcatgtcggttgcattggagtggtaacacctgtgctgtcgtgtgtctgcctggaggggtactttccttcttgggaaagtgaacacaggtgtgttgtcccttctccgtgaaaacactctacttgctggccttgaatagcattctagtgggttacttttctcctagtggtcagagagtatttattggacctctggttccattggcatgtgtcccctaaggagggagacccttcagggggtacttacacctctactgtccgatggcactggctgtgtcacacctggcctgtgggctttgaacctagcatttcagagtgggaaaaggcctcaagccatctagtccaaactctacctgcagatcaggtagaggcccagtggcaggaagtcatcagctaggggtcctcagattacagagctagctctcaaacccaggccctctgtctcccgtctcttgccttccagtgattcccaaatttggcctcctcaaaatcacttgtggaagtgacagcttcctgggctgcgggtgtttgaaaagcttctgtggggattctgatggtgaggctgatgtgggaagcactgtggtgtgtgatcactgaggcacacccatcttcattaatgtgtaagccactcggggataggaagggctaatgcctctctgtactcacagtgcccatcgaggtgcctggcacaccttgcagtagttaattggtatttgtggatcgaatgaacatgttaggtgcccactagcaggggttggtcctgtagtctgtggccatggaacattagaagaataaagctattgtggttcatcctgtagtatagtaagttcgagctgagctaacctgtaataacacaaatacaatttttttttttacgtttttaaaagttagagatgggttcttgctatgttgcccagggtagtctcaaactcctcgccttgagatcctcctgccttggctccccaaagtcctgcgattacaggcctgagccattatatttggccaacaaatagaattatttatttatttatttatttattttttgcgatggagtctcaccctgtcacctaggctggagtgcagtggcgtgatcttggctcattgcaacctccgcctcccaggttcaagcgattctctctcctcagcctcctgagtagctgggattacaggtgtgtgccaccacatttggctaatttttatatttttagtagagatggggttttaccatgttggccagcgctggtcttgaactcctgacatcaagtgatctgcctgccttggccccccagagtgctgtgattacaggtgtgagccactgcgcctggcctagacttttttaaagagtagattattaagcaaagggagagtataaacagtattggtttttcattagcttcatctgtaccgtcaaccacatggttctttttgtcttggtagtggtacaggagtaaagttaaacttaaatcaccaccaacacccccaagctaagcataacttttaaaagtttttaatattttggcaagcctgggagaaatattgcccttttttgggtagatcttggatgactaactgcttactatacacacacctgtactacacgtgattgcgttgccttcactgaacaccgtttttgataactgtgtaatctgaggggaattactaagacaataaaaactgcagaccacgcgctctttttctccagtctgcacatagtttggatatgtgtggtggtgtgtttaagcccatggacttgagttttttatgggacaatccttgtgtgtatcagaatcatacagtcccagtaccatcttattcctctggcattattgaagatacaagaaccagttggcattcaaatatgttgagttcactaaaaacagttgctgatgagggaaacctaacaccctgataataaaatggaaagttgggatttagatgtgttttctcaattgccaaagcctggtggtggtggtgctggtgctggtgctggtggtagtgctggtggtggttgtggtggttttgagtcttcgctgtatcacccaggctggagtgcagtggcgcgatcttgctcactgcaagctccgcctcccaggttcaagcaattctcctgcctcagcctcccaagaagctgggactatgtatgggcacgtggtaccacgcccggctaatttttgtatttttagtagagacggggcttcactgtgttggccaggccggtctcgaacgcctgacctctagtgagccacccaccttggcctcccaaagtgctgggattacaggcgtgaaccactgcatgtggccccaaagtctgttttttttccccaagcccttggataagtagacaaagtatgtatgtaaatggtcctgtcatctcagtgaatgtctcattttaaattttggtgaaagcttatgctgtattgtagcacattattttatctataacattgaaaataattggcctttctaaacatggaactgtttatcatgcagtagggtaaggcagtgccatgctgtggtacttaatctggggaggatctcctcccttttccccatagagcatttggaaatgtgtgtgtggatggggttgcttttagatgttccagtgactggggacactcagtcattggatggcttaaggatgctaaacgttcctgagtgcttgggatagtcttgcagaatgaatacttgtgctgtccagaatgacaagagcacccccagtgggaaacactagtagggtaatgactaatcaagtaacagacatgccctttaacttaaagcagctcattaacatagtattcatttacctgtttagattttgagtatcttctcttcaatctctatgtaaagatacagattgtagagcctgccctatgtatgaatatatatatatattaaaactgtgattctaagaaggggttcttaaggttctggtgtgtccccaaatcagaactggaaattattccttttaacagggccaatggattcctattgctggtcctagttttattactgcagtgccagaacaactccctgatcatcatttttatttttttaaaagaggatctcactctttcattcaggctggagtgcagtggctcgatcatagctcactgcactccagcctgaatgattttttgtagagagatggggtcttgacttgttgcccaggctggtctcaaattcctggactcaagtgatctgcctgccttggtttcccacagtgctgggattacaggcatgagccaatgggcctggcctccctgatctttagacttgcaataattgtttgaggttgcgtaccatagggaatgattgcccatgggtgttggagcataggtaaaaaattttgtggaatgatcggaccagctaagagttggcattgtgttggagctgctggtgctcagatgaagtccttttgttaggaggtgtagatttgttgactcatgcagaacttctcagtagcttacttttttttttttttgagatggagtcttgccctgttgcccaggctggagtgcagtggcccgatcttggctcactgcaagctccacctcccgggttgatgccattctcctgcctcagcctcccgagtagctgtgactacaggcgcccgcacacctggataatcttttctatttttagtagagatggggtttcatcgtgttagccaggatgatctccatctcctgacctcgtgatctgccctcctcggcctcccaaagtgctgggattacgtgagccactgtgcccagccaatttttaagttcactttctacacgctactgggttgttaaaaccaacctcagtaaaagtatccgttttacaagttacttgctttttcaggccaggcacagtcaggagtttgagaccagcctggccaacatggtgaaaccctgtctctactaaaattacaaaatttagctgggtgtagtggctggcatctgtaatcccagctgcttgggaggccgaggcaggagaatcgtttgaacccaggaggcagaggttgcagtgctgagatgatgccactgcactccaacctgggcgacagaggagactccatctcaaaaaaagaaaacaagttaattgctttttaaaagggttgtgtgaactttcagtcagatatgaaactgtttcagaaccaaaaataagttattctaaattcctgctagtcagtttgcaaaatgcttaatatctttttaatgttaattattagctttggtttcaggagatgtcattttcacactgtcttcaaacttagaagagactcaggtttagaatttggagtctgggccgggcgcggtggctcacgcctgtaatcccagcactttgggaggccgaggcaggcagatgacaagatcaggagattgagaccatcctggctaacacggtgaaaccctgtctctactaaaaatacaaaaaattagctgggtgttgtggcgggcacctgtagtcccagctactcgggaggctaaggcaggagaatggcaggaacctgggaggcggagcttgcagtgagccaagatcacaccactgcactccagcctgggcgacagagaaagactctgtctcaaaaaaaaaaaaaaaaaaaatggagtctgaaatctcgtgtgcatggactctggtcatttgtctttgtcctaaccagacagtggccttcagttctaattgtacttggggttcccacttctgaaccagtagatagcagagaaagaaaggtggcatatccagggttctgcatttgtgagcaaacgcccctccactttagttttagtgtgttatgtcattgttggcttctgtgtatgtagctggagctgcatttgttattgagatatttgacttggggctggttttcccatctctaatacatgcccttggaaccataattgagagaaatgcgtgcttttattttatgcttcataacagccattttgtgattttaaaaaaattaccagcaggaaatgaaagaaaagtaggtttttatattttagtatgattaaagactttaaaacatgtctcgttgcctcctagtaaacttgagttctttaacttctggacttggggattgtggagaaaacttttgaaacaagatctggaaaacgatacttctgtacttgttgtaccagtcggggagcctttaagggcatattggatgcatgttagaggatctctcagtcatagtcttaaatgttattgggacggggtgggagcggctggggagactaattatgttcctgaagtaggaagtgacatttggtgagtgcttaatatttctggttccctggctggataacgaaacctctgtcgccatatactggcacaggtaatacgtccttattacatttacacctgtgttaggaagaatccgggataggtatctctccagcttctgtatatttcacttgaaaaatggtgagaagcaagcatttcttaatattaagcattatagttgctatgtggctctgctgttttctttgggacagtgacataaagtagccagatttgagtgtttttcatacactttagtaaatctgggttttctcaagtgataaatttgaaaactgccttgatgtaagtgggttgttttgttgttgtggtggtgggttttttttgtttgtttgttttgagatggagtcttgctccggagccgaggctggaatgcagtggcacaatcttggctcactgcaacctccgcctcctgggttcaagcgattctcctgcctcagcctcccaagtagctgggactacaggcgtgcgccactatgcccagctaattttgtatttttaatagagatagggcttcaccatgttagccaggctggtcttgaactcctgacctcaagtggtccacctgcctcggcctcccgaagtgctgggattacaggtgtgtgagccaatgcgcccgacagtgttttgtttttttaaaacaactacatggcaacattagaaatattttaaggccctcccatctccacctcctcaattctgtgtctcaccatcctcatactatttccatttttacattttattttcatgtcttgtctaaacagagttcacatttgcattgagtgttgcttgtcgtattttttatttcagaagcaatttgcccagtttctactattttcgtaattataatttaatatcactacataatccatttttgatgtgtctttggacatttcaccatttctctctcactatggtttctaaggttgcttcaaaccttctgattcaaagctctttctctcttcccttctctgacttccttggtgccttgggagccctcctgcctcccttggctgtcgtaaggctcatatgagatggtgcatggaaaaataggttaaagtattgttttaacaaaaaagaaaaaaactgcttaggttgggcagggtggcccatgcctataatctcagcactatgggaggctgagatgggaggcttgcttgagcctaggagctcaagaccagcctaggcaacatagtgagaccccgtctctacaaaaagtaaaaaacaaaacgagctaggcatggtggcacctatagtgccagctactcaagaggctgaggtgggaggcgttcgtgtgagcctgggagatcatgactagtgagctgtgatcgtgccactgcactccagcttgggtgacagagcaagagcctgtctcaaagaaaagagaaaaactgcttagacctaagtgtcagtgtgctttattaaagcaaagaagctgcgtttggtttgcactgtgtgcctcctgagacatccccagccatctgcagtcaggagtggtgtgtggcttcctgactagcacaggaactgatgtcaggcatatgccgtcgccacactgaggagcagcttatgtagaaggtgcaggaggttattagaagaaaagaatactcagttaagcgtaatttgtttcattctgtttttcagatcaatgtccgagttaccaccatggatgcagagctggagtttgcaatccagccaaatacaactggaaaacagctttttgatcaggttggtctctgaacttgagagttaactccacctacaaaaaaaaactgttttgcaacatttcagttattttgtttgcgaagcatattaccttgttttactcacttgaggtaatagatgagaaggatcttttaaaaggtgaaagtatttcatgatagcattataaaatgcattaacagacaagtatatcatgcctaggaagtgaggtgtatgaaagcacacagctgtctgttgtataaagtcaggcggattcagtgtgttaccaggcatggaagcaaaggactgaaaagagagttattgtgcttgtcattgtaaggaggtgctggcctgtgtgtctctcaccctgtattagagacgcggcttcctacccgcagctgcctccacctccagagtagaacccctctcactgcgtggatgagtgagccttagttgtctcagttgctgcagcttctcatttctaagtgatcgtacctgaacatctatgaaaggaagaaatgaagatttagagaaataattcactttttaaaattggaagatttttttaaatcaagtatttattagtgatattactacttacttattaaatacttttttccccaataacagctgcttcaaatacagcgttgttttttttttttttctttgagactgaatctcactctgttgccccggctggagtgcaatggtgcaatctcagctcactgcaacctctgtctcacaggttcaagcaattctcctgcatcagctccccgaatagttgggattacaggcacatgctaccacgccctgctaatttttgtatttttaatagagacagggtttcgccatgtttgccaggctagtctcgaactcctgaactcaagtgatccacccgtcttggcctcccaaagtgctgggattacaagtgtgagccaccacgctcagcttgcagccttcccccatcccttttgggtgagtgggaagagggggaagaacaggtcagtcctgggcatttaataaacagacttctagagctttagggagcctctggcctccctgcacccttcagatgaagaaacaggcccagatcaggagttaatttggaattttaggatttactttaagcaaatgctctgtatacctgagttgtcatttctaatgtattcaaccctctttggcattaaatatgatagaagccatgtatttgaaggatggtagcattttttaaagtttaacattatatatcatgggattttaaattagacatctatgtatatgtaaatagtcgaacttgtctgggactcggtttagatgatgttcaacaaatgtccacagcaagttcgactatcactgcttttctgtttacaagacagtcgtgagactaagcagctcaggactcctgtaatgcacaacagaggcttgaaaatgtgaaatctttgctgtgacctagggtcgggattctacctttgctgtatcagaatgtcccatttctggaggtctataagatgcaggttcctctgggcacccctgtgcattgacacccttccgtcccagaagtctgccttgcctgttttcctgcctttcctaggatttctttgtccctgttcctagtaagtcagacccctgggccagctggctgagaggcagaggcaggcagccagaggaggctcaggtgtggcactggatgctttagtcttctgcatgagcacacctgaccggcagcgatgcacccaccgcactgttccctggggggctgtgggctcccatggttctgtgtgtgctggccataacccgccctgctgagtttcatgcaggagagcatcctggagtacaaaggagtaggagtgagattttctaagatttgaaggtagaaccctgaatctgctcaaatttatattaaaaataagtcgttcatggctttgagataatagcctcagttagtaacaagttatttgagtgcaaaaaaagatgttgcccagtggttggactgagcagatgtcctggtttcctggggactctgctagaccatgtgatgaacgacagccaaaagctgttgcccttttgagtgagtttctcatgagtgttgagcctctctctctctcacgcaggtggtaaagactatcggcctccgggaagtgtggtactttggcctccactatgtggataataaaggatttcctacctggctgaagctggataagaaggcaagtcaggattaactatttacaggctgtggattgggtgttggtctgcttcatcgataaggaaactggagcaactcaccctgtcttttgttttctgttcctttttgtttgtgtaaaagtttttacagacaaaaaggttgcaggtttccagtaaatggagatatcgattggaaatcagatctggcatttctccatagtgctcactcattggagcatatgatggttaattgcatagcttttagttgaccttagttttttcaatgagattgttaatcttataaactgtgaatcatccaccatcttgtaagaacctgttattgctttgtttgaacctgtgacagattatcttccaactttaaagagtggataattccattaaccaaccaaaaagaaaagtagtaagataaacattttcttcaaactctgaaaattatccttttttttttttttgaaacccccactgtcctcccaagtcacagcaacaagttaaaaagatgatgggaggtggggaagagtggaggagcaggaggaattcttaacagtaagtttcggggtccagggcccgattggcatgtggccccattccaggtcactggggtcatttccaaatttgagttctccaggattgatagcatcatcccatgaggactggggcttagtgaggcagtagctttgatttccagctgagcacaagagtgtgatagtacttgtttgttttttgttgttgttgttttgagatggagtcttgctctgtcgcccaggctggggtgcagtggcacgatcttggctcactgcaacctccacctcctgggttcaagtgattctcctgcctcagcctcccaagtagctgggactacagctgcatgccatcatgcccggctaatttttttgtatttttagtagagatggggtttcaccatgttggtcaggctagtctcgaactcctgacctcgtggtccgcccacctcagcctcccaaagtgctgggattacagtcgtgagccaccatgcctggcctgtttttttgtttttgtttgtttgttgttgttttttaagaagagacagggtcttgctctgtcacccaggctggagtgcagtggcgccatcatagctcactgcagtctcgaactcctgagctccagggttcctcctgctcagcttcttgagtaactgggactataagcatgcatcaccatccccagctaacttttttttaaaaaatgttgtagagatgggatctcttctacgttgcccaggctggtcttaaactcctgggctcaagtgatcctcctgccttggcctcccaaagcactgggattataggcatgagccaccatgtctggcctgtggtagcacttttgactaacctttttttgtctggagtgctaaaaagatgactttaagaataaatatctcctgaaaactggcttgagggccccattgagtcttggttagaagcctgtgttggggacagtgggccttcgtcttccggatttgtgtggagagtgtggcttgtttcgtgcaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaaggtgagcacaggatgacccggcctgggcaggagcagtcatgccgtcctcggcagggagaagtgattgccttagaagcacagtttaaaaacacaaggacttcgccagtgtcaagtgctccttcatgctagtcattaagtcactgaccagcgacctgaaacatagccagggaaggcgagctgccattcctcatggaaactaaagcgtggccgtgtcctgtgggacatggcatagcaaacttctcgacctgactgctcagctcctcctggggtatgataggttgcccctgtgaaatctgtttttatttagtaatggtcacaaaaattaccccatttggaagaagaggccacttaaaatacctcttagtttttccagcagaactgagttcttgttcaaaatgctaagtcttccagattaactgtcataaatagaaatgctgcacatcaggaaatagaaaccaaagctctttgggattgattgatttgaatggaaagtaagggtttgaatgtgggtggtaagtgggcctccttccttgcctgtcacattccttaaggatgacagtgctgtttccttttgcattccagagtgatggaccagcacaaacttaccagggaccagtgggaggaccggatccaggtgtggcatgcggaacaccgtgggatgctcaagtgagtgctgtgccctgctgttgggatcttgccatctccgtgcgctccagcatgtcttttcctgtgactctagttagtgctttaaagggctctgtgtcaggccttgtgaagaccttgagggaaccgagttaaaagtggggttttcttagggaagaggttttttttaaacaaagccaggtgtcttgcctggggaaagaagcagtttagctcaagccttcaggttctaaaagcttacaccctccctttgtagaaagtgttgtgtctaaacttcatcttagtcagaggggcattgttcacctgcaatcagcattattctgtcaaagagatgctggtttgctcattatatgaaggtacttgtcttacaaagtgtatataaatgaaaaaggatcccaagtgagaaatgctgatgtcagagaacctggacgtggggctgttaatgtaagacatggccgagccacctgattctgggtgttctcgtcctagagccttgtctctggcctagtcttgcgagtctgcattatttcagcctctgaagtttgtttgaggtttgagcctcagattttgtgcttcagggtttcctgtctggcccaaacatcctttatggaaggaaaacaactcaaagcctatgaggagggttgtgggaagacatgtgtgggcaagagaaaaaggaggattgtgctgagtgataaaacttaaaaacctgttagagaaaccagtgtgaatcagttcttcttcaaagtgtggggtttggtggtgaggctccagggcagcacggaccccaccccaggcatagcttctgggctgtatgggtcccctcctcaccggtcggctgcccggcccctgcctgcctgcacgcagcacacagcattgagcccatcctacacaaggcgccttaatttaaaaatactggaaaggttttactgttctagatattgagtgctaccagtgactctgcctgtttcactctccccaattagagataatgctatgttggaatacctgaagattgctcaggacctggaaatgtatggaatcaactatttcgagataaaaaacaagaaaggaacagacctttggcttggagttgatgcccttggactgaatatttatgagaaagatgataagtgagttgaagttcacagttatcttcagtaggtagggtggtgggcctggaaacaatggcaaaatggcaaatttgtgggttatttttgaagtatttatttagcaacttactatcccaaagtaggaaactttttaaagggcttttggactgctgtggccctctcaaagggtggtccagaggtgtgggttatcctctctcatggtgggcggggccgatagtgggctcagtcctggtagaggaaggcagaatagagcagaggctgcctctcctccccgctgcctctgagattccaccccagctgcctgcaggtaccagcacatccatccatagctacttcgcaggcagcccagccagtgctcgactcctggctcgaggtttgtgctaatccaaccaagaatattgatggtgtgatgagagacttgaaaagctgtaaacaatagcctgtacgtgtagacacttgagctaaatgctgggagtctgcaggagatatcttaattgcctcgcattagttacgttgtttgttgagtgagggcctgtaagcaagctgggtagagcagcagagccaggcctctccacagggacaggcagttccgctttcacatacagggcatttgccttctttctgctgaggataaacagggaaagtcatcctagttcatgagggcaagtttcccatggtgagtctgcgacatcagcataatcctagattctggattgatctgatcagaagctacctgaatttaagaggcagaaggaaactacctctggaaagagaagggagaggctcctgactgcctcctgactaccgtctctgccctgattgtccacagtcagcctgattgctctgcagggctccccgaaacaaatcatctgatggccaccaggttcaggggcctggcagagaaggtgccagggcaagaatgctcctggggtctttttgccaagccctgccttttggcctgggttcctgctttccacgtaaagagcagagtggcccagagttcctggatgtaccggtttccttcccagcctcatgctgttccttgaaatgacagctctccccatttcccacttgaggctcacccatctcatctgttctcagatatttttgttctcagcatccccacatctcaggttcccccaaaaccctctctggagttctcaaagggagtggtgctgctttccacaaatgacctgcatgagtccatctccatttgcaaccacgcggattcctgccagaccccagggcacagatctatttcacttgggcaagtcagggacctgtgccagctgtgcccaacctcctctcacctccggggcccacgtggtgatactgcacagggagggaggcaggcgctgtcacaggagctcctcagagaacctggaaatgagatattgaggactctcggttcgctcctactccaagtgtgctggatgcagcattggtaaagaagcacggaaaagccaggcacagcggctcacacctggaatcccagcactctgggaggccgaggcaggcgaatcccttgagctcaggagtcttgcccagcctggggaacatggcgaaaccccgtctctaccaaaatttaaaaaattagctggctatggtggtgcacgcctgtggtctcagtcaggtggctgaggtgggaggatcacttgagcctgggaggcagaggttgtagtaagccaagattgcgccactgcactctagcctgggtgacagagcgagaccgtgtctcaaaaaaaattttaaagaagtggggaaagtgggtacttggaaccaggacaccatctttccgggagaccctagagctgaagccgtggctattaagacagccatgccaaggagcagtgcacaaagtcctcgtgggaacgtatgtgggaaactgcctctgccttggaaatctcttcaatgaccagattttgtaacgtggccaggccagggctgtccaaacaggtttttcaacctgcaggaaaacagccatgggcaggaacttgctgatgtcagcttgtaactgccccagcccacgtaagtgtccatttcttccaagtaaaaacgtgagctgtgtgccctatttagtgctgtttttgcgctctgctccccctcccccaccattgagcgatgaacgtggcaactctctcagatggttctttccccacagagcatgctggggtgttgggcaggctcactttctgcctctcttctccccattcctgaaggcacacccctctcttcatgaaaaaagcatttatgtagatattcagtcatttaataggcccaaattctttcccttttgaacaaatattgacaacttggtagcagcataagcaggagactgtcctgaagtctgaggagtgctgagaactcgccagctgttgcgctgttacctctctcggtagaactaggagaattagatatgcctgaaacattgttcaggtgagaaagctgatctattgaatatggaaattgagctctaagagatttatactctgcaagtaaagtctctattaaaacacctgttttagtattaaatagggtctggctgggaaatctgtctcttggggttcccttttcattgtacacataagcattaagtgggagcatgtaggactatttgtcatctttctttaaacccttagcttggaataggtgggagtataaagagggcaaaaacaggtaagcgccctcctgacaggcattgtaagcttgtgaacagaggaagttcagtttagctgggttacaatttgaaacctgacactcggaccaaaaacaaaaactaacaaaaactagaggaacctgatctttagtcctgtaaaagcactttttctcccttagcttcatccctctttgggcagatttcatcatagaagtccttctgtaggtaggagtttctggaaatgcactaggtccagggcttccaccttaaagggaaagggtgcacggggagcttggggactgaaacaggagccacagaacatgtctcttctttaaattccttgcggataggtactcagggcttcgcttgctttctcacgtctctttccgtatgcactccactgtcaccctctggccctctaacacatttccaagaaaactgcaggcatccatatccttcctcaaaatgaaagtgcatatgatatactagaggttggttatgttttgttcttttgatgtaaaatttaaatacaatgaaatgtaatcttaagtgttcatttgttgagttctgacaaatatgcctgaaaaatgcaaaatcttaagacatgtagaacattatcacactcagctacatattttggatttacattttttaatcattcttggttttttttttttttttgatatggaatctcactgtgtcacccagggtggagtgcaatggcacattctcagctcactgtaacctctgcctcctgggttcaagcggttctcctgcctcagcctcccgagtagccaggattacaggcacatgccaccactcctggctaatttttgtatttttagtagagatggggtttcactgtgttggccaggctggtctcaaactcctgacctcaaatgatctgcccaccttggcttcccaaagtgctgggatacaggtgtaagccaccatgcctggcccattcttgcattttaaagtcatttcaggctgggcatggtggctcatacctgtaatcccagcactttgggaggctaaaacaggtagatcccttgagctcaggagttcaagaccagcctgggctggtctttgccaacatggcaaaaccccgtctccaccaaaagtacaaaaaattagctgggcgtggtggtgcatgcctgtggtcctagctacttgggaggctgaggtgggaggatcacttgagcccgggaggcggaggctgcagtgagccaagattgtgccactgcactctagcctgggtgacagagtaagaccccatctcaatttaaaatatatatattatttcaaactttaaaaagattctaaaaatagtacaaataattcccatatacccttcacttagcttcctcaaacattaacaccttatgtaaccgtagtccaaataccaagataagaaaattaacattagcagtctctagacctcattcccattttaatcagttgtctcactgatgtcctatttctgccccgggaccctctctggagccacacagttagttgtcagacctccctgtctccttcgatgtgggatagttccagtctttttttgtcatgaccttggtatttttgaagagtactggccattgactttggaaagcccttcagcttggattgtctggtgttttctcattatttggagttttacatttttggtaagaataaagtgctgttttgcccttccaggacctctttcaaggtggcacatgtggtcggtatatcttatcttaggtggtgctaattttgattattagttaaggtggtgtctgccacgtttctccactgtaaaatcactatccttccctttacaattggtcagtatatttgggggagataattttaaactatgtagatgtcctagttctagctaccattgatgagattactgtggtatttgagaaattgtgatttttaaaaactttttacgtgtattaattggaattctataaggagccaatttctgttctccatttattcagttatattaatatggactcatggatatgtgtttcggtctttgggttatgatctatgagtatgtatcttcttgctcaggttgtttgagatttggcctttaggagcaccttgaagtgtgagccctgcattctttgcaggcttccttgctgcctggctcctcgagatgcaccaggttcatcctttgtgttccctgttctagtcctggaatcagccatttctccaaaggcctctgtctggtccctgttattggagaatcacgcttttttaatgtgtggcctaagcaaggacacttataaaccctgtggccaccttctctgtagaccctgttcatgtcctatatgtgatctcttaggaaaaaggaaatccttgggctttaattttccaactttggtcaagaattaaaagttctttaactcaaaagtgagtcataattttcatgtttaacctttttgttttgatactgcagttatgcttatgagtggctatgaattgttatatgaggtttcaaagtcctaagaggaaaaactttctaggcacaccagagagccggaggcctaaattttctaaggtcagaacctgttttgagagtcctgtgtagagacaggagccggagaggggatcccagccccttgaagtttcaggatgcggcacgctggctcacagtgctatgtgctgtgggcggagcctccggagcttggatcctagcttctctgttggtgccagcaggctgctcttgtgttttgggagaaagtgctccagaagcaacacatgcctacctggtgccactttcacagcctttcaatgtaaggaggacataggctgaagtcagtagcagggcaaggtggtatctggagttcccctttaatgctctgaaacctgtaaagaaaattacatctcgaagataaaagaacaaactcattgcatgtctgtttgaatgccaggtgtgtttttttttaatggggattggtgattctagagcatagcactgtaaaagaaaggatgtatacaaaagctttgacatttagaaccatggtctggccagtgtcctgccatcattcctgcaggcacaccatgactgactgcgctaattccccagaagggccatgtcaggcttacatgtttgccctcagcctacagagtccaccccactgccttgatctagttgatgtgatcataacgaaacctgtattgctcatcagtattgaagctgttggtaggccatagattgcttgaccttcctgctacttctaaaatgaaggtttttgtgggatgttggaaaggactgctttggagggcagcattgttggatggtggttttgaggatttgtcgttatttccagaatggcattatccctggtaaaatgtgttggaagaatagggtgggaagtgtcaggtgagcagagcaatgtggtcttgaagtcacatgatgaacttgggaatgctaataaaagccagagtctggccagtcatggcattgcattggttaagtaggattagccctgtggggccttcattagggcggttagtttgaaggctgtcctggaagttggagagtgacatgggaagatgtctgtccagccaggagaacacacactggaatgagaaccagaggagcagaatgcatagcaaggcctctgtccgtttctcttggcaagctctgttgagtatggcacgtctaggaacgtgatgggatcttggccctccctgttggtttcatagaactaaatgatcagtaacttaaataacattcaacagtctgtagcagaagagcctgtatgttaagagaggcctcaagggaaagggaggcagccctggggaactgtgtgttgaaaggtgggtctgaaccgtggagtttggggctggatttgacagctcttggatgctgagttaaggactgtgttgacatgggaggagaggaaattaatcagatcagcagactgaaagtagggctgctccagcacacagcttgagagtgggctctggcaggatgagaggtaggtgagtgtggtgatgtgatgtgggaatgaacagcagaagatacctgagggggagggtcaaggtacctgggtaggaatttcagttgacctcgagatcaccagcctgggtaatcataggtgccctagactgaggaaaaaccaaaggaaatgggaacagattaaggttgcagatgccttgcagccaaccacttggcttaacctaggacaggtgggaactatttgataatagcatataacacattgtgcctcttgggttagcttcatattattttaattgaactaataagaattgatttgcgaatctctcttagccaatccaagaacatatgtatacatctaaccatccacttcttctttttaacctcaggttaaccccaaagattggctttccttggagtgaaatcaggaacatctctttcaatgacaaaaagtttgtcattaaacccatcgacaagaaggcacctgtaagttccaaaggattctattcaggggctactgtttttcattcttatacttgtcagggtaacggacaagttatactgtgacgagtagccagtgatagtccaaactcctcatgaggttacattgagggccagagatcctgtgggccaggcaattgctgcaggggagaccacttaacttttcaaatgattctcattccttatgaagaaaagggcagttctgagccattggccaaatgataagcatttcccaaaatgctgtgtttttggtgtggagagccagcctgtccccttgaccacctgggtgcagggactctccccggcacctgacggacagtgggacctgcgagtctcaagggccagatttgcctttcagagctgtcctggaacttacccaagatagggacagtcagacttgcacccaagcattgctggtgcccaaggtttcatcggggcttcacccacttctgttgtcagaggtgtgcatcctcacacaggtgacactggcaggcagtcattttgggaggacatggtaagaaggcgacactttatgtcctgaaatctgatagtattgattgtaatagctgcaaagaccagtgcattatgtaaatttggttttatttattctgctgacatttaaacttttgttaactcagaatatttgagacatacgcacataactgtagcattgtagaatgggtaaggattttgttatctaatcagaaatctagttctctaaaaaattgccacctgaagaaattctgttaccaccttagagcctgttctgaattttacgaaaattatagattggaaaggactttgtgttctcatgtaattttggttccttagttacagtgttaagcttggagaggcaaacatgggctgtggtccataccttggttgtcttgttaacccttttgggactgggtactgcttagcaatggtaaatccacttagaacagtatgtggtgttattgtcctgttacttctccccacatacaggtttgtctagcataatttaaaatcagcaggtcttgacaattttgtgaaagtattttcttctttgttaaaaacgtcttggccaggctcagtggctcacgcctgtaatcccaggaccttgggaggctgagatggccgaatcacgaggtcaggagttcgagaccagcctggccaacacagtgaaaaccccatctctactaaaaatacaaaaattatctgggcgtggtggtgggcgcctgtaatctcagctgctcgggaggctgaggcaggagaatcgcttgaacccaggaagcagaggttgcagtgagctgagatcgccactgcactcaagcctgggtgacagagctagactccgtctcaaaaaaaaaaaaaaaaaagggctcctgctgtttgcaaactcttggctgctactctgtgggtagttgcacggttatttaaaattaaacgcgtattgaatgcagactctaaggctccatggcagcagttcatattatgcaacagcatgaatggagggtcatagcgtcttcatgtcacttgggtagtaagattggcacagtttagaagagcaagaaaatgctgaaatctcttcatcagtaggctactacgtactctgtgacgctactgccttttcagaacacttattaaaaatttgactagagcagcagctctggactagactgtttcagaatgtttgtgcgtgtgtgtgtgtgtgtgtgtgtgtgtgtgtgtgtgtgtgtgtttgatgataagtccatctcttgaaaagctgaagaatattttcataataagccccaagcagaagccattgtaacgcatctcgtgcatgtgcctttattatagagtagcctcatgtgaagccatctcgtaagcaaaagaaacattcgctggtggcacgctgtcccaggcactcttccagggctgtgtgcaccatcaacaaggcaaagctcctaccctggtgagcctacatttacgtgaaggaaagggttaaaaaggcaactgagatgcttcctggtagtaaatttaacagtacagctgtgattaaaaactaagccggatcagaagatgggggtgagattcctttaggcaggttgggcaggagccacactgaggaggcagcatttgccttgagtgggcactgctggtttgaggaggtggagttctgtcacccccacagcaccccagggctgctcgaggcactgccccacctcagtctgtaaactttgggcagaagaagttcaagttttcgacatcgaactttcttgtaaaaaagaagaggcccaaagtttgaggcggtgggattccttatcttgtgttgactttcacgggtcatcttcaccccaggcggtttctgctgtgaactcacaaatgagtctttgtccagttctcacccaacaactggcgtctcctttttaaaagccagcttctcttccctgccaaggtgcatacagcagtttggggccacactttggctctttagatgggaccttgtatacagctgacacggcctgcccaggtgacactatgaggggctgaggcggctgccttttccctttcaaaagggcgttttgttcctgtggccttgtggaaaaggcagaaggctctgaggcatctgaaatttggagaaagtaagcagcgtttccgctctgactcctcggacgcttcccccacgtgaccttcccaggagccccgctgcctttttgcctcccgcggctgcctcctgccatctctgcggccagatgagccttgggattggcctcttgtgggagagtttcctggcatcctggggacttgaaaaggggctcttttaccttctctccttctgtatttgtagggtcttgggtttatttttcttgaactttccttgtgcctggtttgcatttttaccttgctggtcctcggccagtttaaaaaccctgctccaggtcttgtcgtgttgtggttctgcatcaggaagctgcatcctgcatcaggttagggacttggatttagaaacatttcagtatgagtctttgttttaacttgaagtgagaaaccggcttccttcaaaggcactgggagagatttcctgccaggcaccatcctccctcacccactggcagtggactccccaaattctggttcccgttgctggcaggacctgtcttctgcagggaaagggagagagggagacattgttatgttaaccattgaggtttttcattgatccccccacccatgcacccccacaaccccataaaggggagttggtgctaatcagcgttttctgagtcagggcctatttggtagagtcctccaaagctgtaatgcaggattgtttcctcttgtgtaataagggataggtgggtcataaaaatgccgattgctcccagctccacagactcctccctgggaaacccaatgacttaacagcaagggtgtgaaaccccaaagacagccccacccaggaagttcatgggctctcagggcttggcatcacctctcaccctaggatttctggaacagatgaaaagactgaagctaaatagattcttctcggatgtgttgatgagcccgctcagccggttcctcgttaggtctcagaagttgctgtgggatatatcgcactgtttttttgttttagccaccctgtccctctgttccaaatggtcagaagctggatgctgggggccctgaggttaagaggaagccaacagagtcactgaaaaataacttttcatgggagtttctaaaccatattcttctgtcttgtaagctaatcacagcagtagcaaggagttgggaccaagattgtcagctgtgtcccaaatgtttccagtcatggtcacgagtttcccgaaggctgtgattctgccttgttttccaggaggctcctctggttgtggtcttgcaaggcactagcaattggagtgaccgctgtgtgtgtcagccagctcttcctgcgccgagcacctcctgaacgtcaccgataaggcggggacgccagcatctaatgggactgctgggaggattgagtcccatatctgaagtcccttgagataccggcatccctgccttatggttgaaggcactgagcctggtgaagggatgtgctcaaggctgtggagctcgcacgtggctgtctgtgctgcacgagctggcagtgcctggcaggtactgcacacctcaaataccctgggaagataagagatgagtgaatgtgtggcccctgcccttgggagctgatggcctcataggagtgagatgctgaaaggagtcactggagtgaagtgacagtgccactgcggcgagtacctgtagctggtgtggcaggagcagggctggatagctttgaggagagagaaccgagtgcacagcggaggctgggcccagagctggaaggtctctgtgtgggttgggcccaggccctggagctcatcctggagctcccaggctggcagtgatgggtcggggtggtgacccagtcagtgtagcaataacagtgtgggaggggaggctgtggcagaggagacaggaagcccaaatagcagcagaggcagtccaggcaagcatcggggatggggagcagcagtgaggctggagaggacatcatgaaaggtggctacctggaagagcaggcagctctgagacttgaaaggtttcccaaggctgagagttctcaccttggaaaagctttgcagttaacgtgcagtggcatttcagtgtgcatgcaggatgtccctacccacacacaactgcacacacacgcggcacctgcccttcctccacccgtcccagagaatgcactttcccagtgctacatacccacacataaccgcacacacacgcggcacgtgcccttcctccatctgtcctggagaatgcacattcctagtgccgagatgctgccatccctgttctgctacatttgttcttttagaaaagttctggacctttgtgaaggatggtttggagaagaaaaccaaacgaaggagcttgagtccaggtggccctgttctgttttgtaggactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggtgagcgcgtgaggccagagtggggggggcctgtgttctcccaactcagccactggcagccagtgcctgtcaggtgactgtggagctgatggggagagtgtggtggaatggaacccagtcaccacgctgggatcttcgaggcctttgtctctgggcggttgctgtggtgctgagcctgttgtcagccctggagcggctgctccgtcaggcagctcaggctggcagcaggctagggtggccctcaggataccaagtccatcctggagcttcaagtacccgtgaagtgtgttgacccctcactttcctgccagagtctaaatctccctgtgcctctttttccctgcaccaggcaacagctggaaacagagaagaaaaggagagaaaccgtggagagagagaaagagcagatgatgcgcgagaaggaggagttgatgctgcggctgcaggactatgaggagaagacaaagaaggcagagagaggtcaggcgccctggggctggcactctacactgggtcatgcatttccacagagtagcaggggccacacccacccacccactcaccaggaaggaaaccaagaacgtgtcccacagcgcagactcacagccgaaatgataaaatggttatttggtttggaaaacagttctgtacttatttaactttgatgctagttgttctaagactttgtattttaaaatttccctagtcttttgcggtaagtgctcaatcacccagtttccccgatgaggacagtaaggtttggtgcggtacagtgatttgcccacagtcccccagcccatgactgacagggccatgctgcactgccctcgacctctagactaaaacccaaaggcgtgttcagagccagacttcccagcacagctccagtcaacaaccccagcagctgggccgattacacaaggcgccacagatgctgtattcactggcagcccttacagcacacatgggaagggtgttctgtgttctgagtggagtgtggaccaccagcacagcgggcggctgacctggggagagtagcgccaagagggttgagtcaggcatgccagagagagggcgcctggctggcgttggacgggtttctagccatcttgaggaagttgtcatggatacagcagcaatgagctctgtgaagtgctttcctccagggtcactggaagacatcccctcaacctgtgacttggtctagggctctgtggctttgggggtgggaatggaaagcgagggctcctaggtccctgggctgagggtttgaatggctctggctttgtgtctttgcagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggtaggaatggcctgagtttcaagatgctgaattatagagaggctgcttctgaggatggaaaatgtgacacctgccttgtaataattgtcatgactggaagctgtaaactgatctgctggggggctgaaggcagctggtggggaaggggctgggctgttgccagggtcacccattgaaggtgggtgtgggcatccaggaagagatgccgggggtgcacaatggaccctgctggccatggagtgggggtggcggggactcaggtgtcacgttggagactgcttgccaacacacatgaacactcattcacaactggactccgttgaaaggatatcagaactgacgtgagcttggcattcccttcccaggctgcggagcttgcagaatacactgccaagattgccctcctggaagaggcgcggaggcgcaaggaggatgaagttgaagagtggcagcacagggtgagtctgcacgggggacacctccgcacggccacagcacctgttgcccaattgcctgcggtggggcccttctgcaggtgggtgggttgggggagaggtctggctcaagctgccacatcccactggaagcttctgggatgtctcatgatcctctgccaataccagctgtactactgaagtagacatccccaaagagatgggtttgactttgtacacgagtcagtgcagctgctggattcatagagggaggacctctgattgactttcacccactttgctccctccaccccgaactgttcagtgctgatctgacagcccccggtcaggaactggttttaaatctaattatatatgtgccccttgcaatggggtcgcagtgcctgaaacacgacctcctgcagctagtatatacagcgggcaccatggaaagatccagctccttggacgtctccaggctggagtgagagctgggctctgctgctcatcagctatttgggggctagtagcatcacttcttcaagcctcattttcctcattgtagaatgggggcaatacccaactcataaggttgctctgcagatgcgaggtcccatgcccaggacctagcacagaggtttagtcagctgtagctctcattgtgggacgcacacagagcttgtcgctccgtctgggatcccctgtgccctccaggaaggcacagcccctgagaagctctggggatggttcccactggagactgcacaccaggctttaagcagctcctctccttcacagacccgctggcccgtccttcccccactgtggcttctccatctgtggaggtgccttctggggacgtgtctcccggctctccagggctgctgctgcctagtacctccttgcctctgttccagcccccattcccgctgccgatctgtattaggctgttctcacaacggctataaagaacaagctgagactgggtagttaaagaaaagaggtttaattgactcacagtcccacatggctgggggaggcctcaggaaatttacaatcgtggcagaaggcgaaggggaagcaggcacctcttacatgagggcagaagagagaaaagcaaaggggggtaatgccaaacactgaaaccatcagctcttgctcagaacccacccactagcacgagaacagcataggggaaaccaccccgtaatccagtcacctcccaccaggtaatgccccccacccccagcatggggggattacaggtggagatgagatttgggtggggacacagccatatcaccatcccaagttgcaagcggaagactttggttcttaggtttttggagaaagtacctgttaagtgaggagagctggctacaaagcagatccacactaagctcaactctagggctggctgggatggaggcgggcgggactgggtgtgtgtgaagctgttggaaggactgcaagtggcgagcaggagagcacttgataatgactgtggcatgaagggaggctaggaacagagcccgttactcatgctaacaggattttttttctaaaaattatataatgtctagagttacaggtaaaaaaagaaatggtagttttaaaactgcccaggttccggcatcacagttcctcttcctgtcttggacgcagagggttgtaaaccccccatgcaccctgagggtgctcctcttcgaagccacagcccagcacagttcagtgctgccttagcctgccaggacagagggaggtgacagtctgttctcatagccaggaggataggacttctgggtgagaagtcctcttattaatttgctttccaaaggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctggtgaggcccaaggggctctgtctccagggagcctgcctcgcttttggagcagacaggcttggggagggcagtgatgtgagccagccccacccagcacccctcttgcccttcctgttttcctaggggacgggccgggccatatggggaggaagggactagaccaatgctgcttaatgttacagacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaagca

SEQ ID NO: 314 - DNA, 22936 bp, Homo sapiens
  misc_feature: SLC34A2
accttcgccatatatacccggggcgctgcgctccacctggccgccgcctccagcccagcacctgcggagggagcgctggtgagtaccgccgccggggcaggggcgcttcctcgctctttcaaggactttgattcacttaattcttgcaaatacctctcggtgctgacttcaaggaacttggctggctttgggccgcagaagtgaaaaacacaaagctctccacaatgttcaagttgttttcttcttaatgttacggttattgcttttattacagcttttgctgctacactcttacgatcgacagtgttattaatcagccacacttgtggattctaaaatgatcactgttttgagagtcgtggtttggaagaggaaaggcccaggggatagaaatctccacctaggaatcaggatagctaggctctttgtggctgggtcaccaactagccatgtgacaacgctagtccctgtgagcccctgggctgccgtcttccattctttataagaaggggaatgcgacatctcaggaccatgaaaattctaggtttgtggtggctgcctggtgatgtgacactgccccccacccaagtgtgacttccacgtggtacagtgcttgtttgcagttatttaaggtgcctaggagacagtcttagtttgtttctattagggcccgtggccatcagcgaagggtccgtccttcagccgtcttggggagcaaagcccgcaatttatgttttccaagccacaaatgggtgagcaggctggggagataacttacaaggagatgtgcacaggagtggttgggttcggggactgcgcatcctcaggccagaaagttgggggctgcatggcatggagttagttcaggttccctgcaacggtgcctgccaccggtggctcgcactgcgctgaagagagttggaatctcgttttctttgaggaggtccctttttcaaacatgttgatttcatggaagcagcttgtggatttcatcactcgagtcccctcttcctgtttgggtgccccagggggtttctgtgttagccctgatcgctctgggccttgtcgttctttcctttttccttcttcccttgtgtgctggcagttctttaacttgtcctgggttgggtattcttggaaaactgtgcttgtaggagtggccgttgtttcagattgttaaagaaaaacaaaaataaaaaagattgcctcttttgtcccatgcccgctgatcatgatcttctctgcttttgtaatttggggaatgggtgataagaaaggcgtgctttgtaaaaggtttggatgctaaacaaattgccccatccaaaactccccaaattgctcaactgtctcaatgaagcaagtcccctgtggtatgaggatgggcttctgattgttgctgttagacacaaaggggacaaaaaaatagcccgaattcaatgcaatgaggaaaacagcctcacagaatcagagtgctttggaataaactgggctttagtaaccagtttcaggcatcttccactcctccatcctcacccacacccccacttccattctggggaccgcagggagcaatcaggacatcccagggaatttattcatctcagtgaatttttaaaatgcaaaggtacaaaaagagggctataaaaagattgcggtatttttaagatgtttatatttacaaatttaactgctttaacctccccccccaatacaatgcagcacaactgatatagttacaagttatttacaggatttattttaagatatcataaatacaaattgatagtgcatggtgagggtgtggtttggtgatatggcccaagtttaaagtttattagtgtgccacatcaaaaatgtaaactcaagttatctatcaatgtgaggcccaggccaattgcttccttgactcctctcatcactaccaccattgtgtccttgaagagattattattagcagtaatgtagggacagggtctcactatgttgtctaagctggtctcaaactcacaggttcaagggactctcccactttggcctcccaaagtgctgggattataggtgtgagccaccacccttagcctataggggtgattatttttccttgtgatggctgtaagggaagcagaggaaaaggagacgtcaccctcttgggaatttttgaagcacagagtcattctttcaaagtacaagaaagttttcctgggcatcccgagaacactggcctgcatgaggttgaaattatctctgcagtgttgtggtgcctatgtgatttgaagccattaacctctctgtggctcagtttttccctctatagaatgaggatactgttcattttaaaggagactctaagtttacatagatacatgaaatgctgtgagtaaatttgtgcaccaatttgcaagtgccaggcacaaagtctttaataaacactacttggctaccatgtgcccagcactgtcctatgtgctggggatacaatggccatactctagtccctgtgcttgtgaaggctgccattctgatgggagactgtgtgtccatgttctggttcctcacaggaccactgccctgggcttcctcctctccccatttcttcagatggccttgactgctgctctgggcacaaggggcccaggaacaggtcttggttggagaagcccaaacaatgcgaatgtaggggttgggtgactgccaggtaccctacattcccctgcttcccaagtctgagccaagtcaagaaagttcctctcctgggtcttcaagaaagaataagagctctttctggcagtgggtgcccatgtggtgcaggaagtggagccaagagggtgaggcacacaggcaactcggttatagaggccagtgtggcagcgggggagcccctccctgggctttagtaaaaagcttccaaatgatgacttctcccttcctctgctgcttctggcaggtggcaagaatgtgctggagtgaggccttgggaaggctgggagagaacaaggcagtggttgcgccagggctatgggggtaggagaaaggcttagaggggctcagagctccagggtacattctctgcctgcaccatttaatacccacccccacccacccaccccacccccaccaccctcccctcctgctcatccattgcaacattcttgggcgggcatttccagcatctgaatgatcatgtgggagtgacctgcagacatgccaatctagccagctatccgaaaacactcagagccctcaatgtgcctagacctaaggcccctgggtgccctggtgctttgagggctggagaatttctcctccctttgcccctggctgtgagatctgtggaaaagcttctggctttggagccagcagtcttgggttcatatcctgacaccagctccaggtagttggaggcaagcttctttgtttctctgtgcctcagtttctttgtctgtacactgagaagaaaaactccttccttggtagatttaatgaggtcacaaactgtataggacactcctctgccacaaaacaaacattagcatctttctctcacaggctttggattcatttattcaaatattaactgagatccactaccatgctgagcattggagatgaagagcttatagtctagggtacacacagtggaaatgaggccatttactgttcatgacacagtgcatttccacgtaataaacactcttgtttattgttcatgacacagtgcatttccacattgtgtcatgaacaataaacaagagttccgagtgtttactctgccaggcaccatgctctagcctcacctacacttattaaccaattagtcctcataacagctcagtaagcaagatggtattgtccccatttttacaatgatgaagctgaagctcagagtggctcagggttgcatatagtgaggggcaggcctctgcagagccagccctccctcactgtgattcgcctctctccaggtatcactgagccatcttacctttgtgagcttagaggttgagttgcatcttttaaaataattttcttctaaaatttaaaaaatcacccacagtctcaccactcccttttacctccagagaacatttctggatcttgtctgccttgttgagatgatgctgtgaatgggaaaaagaagtgctttagatgtgaagtttatctaaagcatttccctatggttttactgattcagtataacctctttaatggcatgctcttacaatgcatggacataccatagttagaaggagtaatttctcttttttcattttttcacactgtaaatgatagagcagcaaatatctttttggtctacatcacattcattctatcataaatatgcccggcagggctcaagaccttaaagatgaagtgatggacaagacaaagtccactttttggtagggtttgcagtctggtaagcaggaaataggttgacgaagaaaggagtcaggtggactcaggctctaagaagccctcttggaagaggtgatcagagtaagttaggtatttctgaatttctgagaggaaatattcctagcttcctgattcctagaagtgaaatgactgggtcacagacgtgtgatgaacataaggcactttggacagtttgctaacttttccagagcttctagcagtgttcaactcataacatcttctccagcatagcataatgaacttaaattctttttgctactttgatagttgtcactgttttagtttgaatatatgggattgcttctgtttttttgagacggagtttcactctttttgcccaggctggggtgcaatgatgtgatctcagctcactgcaacctccacctcccagattcaagtgattctcctgcctcagcctcccgagtagctggaattacaggtgcatgccaccacgcctggctaattttgtatttttagtagagacggggtttcaccatgttgtccaggctggtctctaactcctgacctcagatgatccacctgcctcggcttcccaaagtgttgggtttacaggcatgagccactgtgcccggcctggattgcttcttttttaataggcattttagccatttgttccttttctgtgaattgcctttctccaatcttttggactgctttgtctaatggacaaggactaattgtctaatgtcaaagaacaaggactgcaaggactggaatgtgaggtgtgtcaagtaccatgtaactgagaaaggccttgtgaagaaaatagattgtaagaaggtcttttctgaaggctgaaaagaatgtggttctaacaaaggatgattaatccagacagcatgacatagtaataattgctgctatttattggatgcctcctcaatgccagtcactttctagacttttaatttcactattagtctcataaccctgcaagaactgttccattttatagatggagaaactgacactttatgctcagaggcataaagggacttgcctaaatacacactcattaataggtggcactgctggattttaaaaccaggtccatcactcttttcacagaaggcctgggtggtaggtaaaacacgcagaaggtatatgaacacctgcatatacttatatattttgagacagagttttgctctgtatcccccaggctggaatacagtggcatgatctcagttcactacaacctccgcctcccaggttcaagcaattctcatgcctcagcctcctaagtagctgggattacaggcacccaccaccatcccctgctaatttttgtatttttagtagagacagggttttgacacgttgcccaggctggtctcgaacttctgacctcaggtgacccacccaccttggcctcctaaggtgttggagttacaggcctgagccacctcgcctggcccctgcatatatattcacatacacactaagttgtataaatctgttaaattccactggataaggttttgcatagatttgcagtgcacttgtcttgatataagaagtagatggggttccattgaagggttgtgaggatttggcatgctatgagacaacaaagatgaatgggcttgcaccctgcctttttctttttttttttttttgagaaggagtttcacttttgtcacccaggctggagtgcaatggcacaatctcagctcactgcaacctctgcctcccaggttcaagcgattctcctgtctcagcctcccgagtagctgggactataggcgtgtgccaccacgccggctaatttttatatttttagtagagatggggtttcaccatgttgtcaaggctggtctcaaactcctgacctcaggtgatccacctgtcttggcctcccaaagtgctgggattacaggcgtgagccacggtgcccgttgcaccctgcttttgactgaaggagagagtcaagacaaaaacaagtttacgagattaaaggtggtacatgcagctaactcaacactgtacgaggtagtttgctttagcgactgggtgagtgtttgaaggggaaccacagaggaaatatggtgcttaatatgccacacttagggggcataagtgtgaaatctttcccttccttttactgccgcctccggccgaaacccccacccagttgatgctttgcaaccaatggttcttcctcttatagcatctcggtgtgcctcctttccatgactgctgctttaagctgttttctcatccacagaccatggctccctggcctgaattgggagatgcccagcccaaccccgataagtacctcgaaggggccgcaggtcagcagcccactgcccctgataaaagcaaagagaccaacaaaagtaagtgtcgctcgtttgtctgcagatcggcctttgtgaggaccccaggagactcaggtctgattcctcattaccccttttgcttgtttcagcagataacactgaggcacctgtaaccaagattgaacttctgccgtcctactccacggctacactgatagatgagcccactgaggtggatgacccctggaacctacccactcttcaggactcggggatcaagtggtcaggtaaaagtgaggccagctgagacattcaggagggaaacttcctgtggttcacggtgtcatcatcctcctgtccctcccccttttcattgttctgattcccttgaagcaagggtcctggctagggatgtcaccctctcatctttttttttttagacggagtcttgctctgtcacccaggctggagtgcagtggtgcgatattggctcactgcaagctctgccccgtgggttcaagcagttatcctgcctcagcctcctgagtagctgggattacaggctaatttttgtatttttaatagagatggggtttcaccatgttggccaggctggtctcgaactcctgacctcgtgatccaccctcctcgaccttccaaagtgctgagattacaggcatgagccacagcacccggccaccctcccatctttgaggtagagtcaaagcatgttggagtaattgggggtcattcattcaacaaatgtgccaggcactgtggttatagcaaagatggacattgtctggctccttataattcgctgtgggtgatgaggttccaggtactgctttggagatgctgtggatacagtgatgaacagaaaaggcccctcttctcagagagctttcagaggggtcccctcaccaaaatgtgggcatatttctagtaaaagaaaatatgcagccagacagctggatgcaagcaatcactgtttcatttccaaatgtatgtagggcagaaggtctgtctgtgaactagacagcaaggaggaaaaaggagattggggtgtggggtggggaggagaggtaggaaggaaagagctgggagggggaagatgagaaccattttaaaagccagtggagtaaacagcacttaaggatgtagcatcccaggatgtatgatgccccaagccctccataaattgaggctgattgctgctgtgcagctgcattctagaaaatactctgtgctgtttggaacgtgacagccattatctccgaccctgcacttagcaggtggctagtgctgtcaactgcctcactcagtgacactgtggctcagctgagcatggagcctggtttttctgtcgcagaccacattgaacccctcctcccaaacgcaaatcctttagaggcactttaccaggggtttcagctaaatggaccacagcggtaactgctttgaaagctgcagcgatggctgcttcccatctgtaaggctggctagacataagaacttaacggctgccaggctgggaagggaggggaggtcgggggagctctgagctcattgccaaacttctcagggtttccaacactaaaagtttcatgcctttctctctctccccccatcccacccccctgcagagagagacaccaaagggaagattctctgtttcttccaagggattgggagattgattttacttctcggatttctctactttttcgtgtgctccctggatattcttagtagcgccttccagctggttggaggtaagaatgaaagggtgagaggtctgcgggtgaggggcattatcttgaaatgtggttccgagagtaaaactcagcaagccctctccagctgcagcctcctggagtgttttaggactggaaccgacctcagatcatttatgaagtctatgctttccgttatagaagagaaaactgaggcctatacaaagggctatgacttggcccaggtggcttaggccaggagctggggctagactattccaagctatccgccagttgagtttgtccacaaaccccaggcaggaagttgtctgacatacagacttagctgaggaattcctatatcctccacaccagagagaattctggaatgagaaagagtgccctttcaaatatgggcccttgctgggggaaggacagggccccttctctgggctggaggaatctgcatccattgtacttaccttcacagcccttagggctgcgtgtgcccatgcagtgtgagaacccaggagtgaagtcaccatgtgcttggttccctttgtacctcaatggtgatgtcagaaacaaacaagcagcactccgtctactgggtgcaggcattttcgggggccctctatcaaacattctttcccagagccctcccatttacggagagatcatgaaccagccctgagactcacagcctgtgattagcagagtaagattcagtctcagatctgggtgacacaaaggaccatggatttctgcaacccttggtgcctttcttgggaacccatctgtgtgacttgggagagttggggaggtgggcattcatgggagagcatgaggggcaaacacttcctggacattgcttttttttttttttttttttgagacagagtttcactcttgttgcccgggctggagtgcattggcgtgatctcagctcaccgcgacctccacctcccggcttcaagcgattcttctgcctcagcctcctgagtagctgggattacaggcatgcaccaccatgcctggctaatttttgtatttttagtagagacggggtttctccgtgttggtcaggctggtctgcaactactgacctcagttgttccgcccgtcctccgcctcccgaagtgctgggattacaggtgtgagccaccgtgcctggcctcctgaacattgcttctgggctccctggtccatgggagcatcagctaggggctttgctgtctggttatctcagacaaatcacctgcatcctctgggcttccaccttctttatacaatggacttgggaatgcattgatggtctcaggtacactcttgagaataactctcccagcattcaattacaggctggtgctagggctaagggtggatagagagatctactcttggaggataaatctgaattgggtatacaccccagagacatccaggaggctcattggaacccactggtcccagtatggagttgaggctgggttcctgagcacagaagggcttgctgactgaggagtgtttgaagagtgggaggatgcagggtgaaggaacaaaagtaaccaggggctcacagtgggtcgggaaccagggcagagagacagagacaggaggcacgtgtgggcagctagtagatttcctgccttatcggggcagcactgggaagaggcatggggaagcaagattccttgggtgcctgcagcgatggaggctggactctgcaacccacagccagctggccttggatggagacttctgtttactcagtgcccacctaatccccctcgatcacgttgtgattgtttttgtttgtttgtttgtttttcccaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcatgtgagtcggggcacccatgagcccacctgcattccagacactctcctgtctatctgagggtgggaaggacgggggaggaattcactctgaatatgtccaggccttgccaccattgtcttggtatcttgccccagctacaatgtgtttccctcttgatccaaggcaacttcctgtttccatttcgatggcaggatctggaaatagaccctgctgctggagttctcagctctgaattctctagtactgtactttccagacctgtagccactagccacatgtggcagtttaattttgttgaaccttaattgatttaaaattaaaatataacattcagttcctcagttgtactagttacatttcaagtgttaaagagccacatgtggctggctggcagctaccctattgagaagtagagacatagaacatttccttcactgcagaaagttagttctctgggacagggccactctcagtgctaagaagaaagacaacttaatcacatcacaaattgctctgggacaaccgagcttgggagatggcacactaaacttgtacctgtctgataattgctgcagctacgttggacagaccctctgagggggaccagtttgaactgattattattatttttttttctattttctttttaaatagagacttgggtctcactgtgttgcccaggctggtctcaaacttctgggctcaagtgatcctcccaaaatgctgggattacaggcctgagccacagcccctgaccagaactatttttcttcccaagctagcatcttagccaaaattaactagaatgtttctcgtccagttagaaaaaggtattacactttcaaaatattttacttgtttatatcaaaaaaggtgcagcaatatgctgattttgttggaaaaagttacactgcctagaattaaatgtctgatatccagcacagaaatgatgcttcctggctgggcctagtggctcacgcctataatcccagcactctgggaggctgaggtgggaggctcacctgaggttgggaatctgagaccagcctgaccaacacggtgaaaccccgtctctactaaaaatacaaaaattagctggatgtggtggtgcatgcctccagtctcagctactcaggaggctgaggcaagagaatcactttaacctgggaggtagaggttgcagtgagctgagatcgagccactgctctccagcctgggagacagagcgagatccatctcaaaaaataaaaataaaaaagaaaagaaaaaaaactgatgcttccttaaaggcgagcctgtgtgccatgcacaactgactcaactgtacatgcaagccctgcactcatccacctaagtccttaatcagtgggtgcctcctggtctccttcaggctagccttggatctgcaatagggaggaaggaggaagctagaaaggcactttcttcagattcatagtgaggtgcagagtgaggtgcaaaaaaaaagtttaagaattcacttgcatagaggataaaaactacttctttagaggataccagcataggtaactttagcctgcctccaggctgcctttctaagcttgctaatggtacttttccatcctctagtgctcactgttcgggctgccatccccattatcatgggggccaacattggaacgtcaatcaccaacactattgttgcgctcatgcaggtgggagatcggagtgagttcagaaggtaagaggctcaaaaccagcctttgcgacatcagctctattgttcttggccacgctgttgtaactgcttttaaccagccaaagatgacatgcttatcaggttcattcctggagttcctagaagtaaccacagggaggtatggctagggttggatcacatactcaccagctgattagactcagctccctgatcggcagagcagggataatactatctatcactactgagttgttgtaggattaaatatacaacccagcaggtgagtgttcagagcacccagcacattgagttcactaaataaatgcaaactctagctagaaacttagccgctgggtggcggaattgaagcaaggccagttagaagagtaggatttattgggactgggcgtggtggctcatgcctgtaatcccagcactctgggaggcccaggcgggtggatcgcctgaggtcaggagcctggccaacatggtgaaaccccatctcttctaaaaatacaaaaattagccggccgtggttgccagcgtctgtaatcccagctactctggaggctgaggcaggagaatcgcttgaacccgggaggcggaggttgcagtgagtcgagatcgtgccactgcactccagcctgggtgacagagtgagactccatctaaaaaaaaaaaaaaaaataaataaatactgttttgtttggtcataattataacttatttaaacttccactttcggtcagctcaacccatgccaccttttctttgttcttcacttacaagttaataaaaaacaaaacctagtttctgcgtatgcagaaactctgaaactagagcaggtagaatgctggaaactcttttctttcaaaaaggttaatgtgaaaattaagtgtttcttagcctcttctagctagttttttttttttttcagtttttttttaaaaggtaagctgtttcattgaagacataaaaatccagaacagagttttttaaatctggagataagatggaatcgaggaggaatctttgaacctcctcagatggatgcaaaatgttttagccttgtttcccatggaaactattcatgtttcatcactttcaagaacttaaaaaaagtttaagaattcacttgcatagaggtctttttaagttaaatttttttattgatacaaaatatttttacacctttctgggaaacatgtgatattttgttacattcatagaatgtgtagtgatcaaatcagggtatttgaggtgcccaccgctttggggatttatgatttctatgtgtttggaacaattgaaaactccagcatagagggctttggttgccttcatactggtccccacctttccaaaagaaggtagccttcaatatacatgatacaaaagtgcccttgatgcaattcttcgaaacagtgattgctgagctaattattccagccgtaacatgcttgctggcccgcagcttcttcatctggccaatgggaatatagataccagccactttggggatcgatatgagagaacaaaaatgagattgtgtacatgtgcacacttccataggtgacacctagcagagggtggcagatgatacaggtaatgacccacctcacatggtgcccacttgcttagtgactaatctggctgtcggggtttccctcccatagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccaggtaacttagctccttcagagagagaaggagactaacttcctacccacaacatcccctacctgagctgacagatatagagtgtctacaacactattctgggcctggcatggtggctcacccttgttttcccagcactttgggaggccgaggcaggtggattgcttgaggtcaggaatctgagaccagcctggccaacatggcataaccctgtctatactaaaatgcaaaacattagctgggcatggtggcgtgcacctgtagtcccagctatgtgggggctgagaaaggaggatcgcttgaaccccgggaggtcaaggctgcagtgagctgagaattgtgccattgcactccagcctgggtgacaaagtgagactgtttttaaaaaataaatagatgaataaacactactctgtagctgcctctggaaaaggccaagggaggcagaacttttgggccacctgatagagtgactgaccttgatggttactttgacttccataacatgccacctttattggggtggaggtgcttcttaagactggacacttgagaccactttgttcccactgctgtcctcaacaccagtggacttgataaagtatgatctaccctttcctgcctagagtcatctcagccccttctccctgggtccttgctaggaccttgtgttttcactcttactggttttcttggccattcagtcatccagaaaatatctactgtctgctccctagatatcagtgcctctgcagatagagtgagtcccactttgcctctctgggggctcacagtcacatttatctccttagagcccctctcacttcaaccccctgggtttgtgtcctaaatcggttctgaggatatgctgatggtttcctgtctactgtttccacagctggataaaaaagttatcagccaaattgcaatgaacgatgaaaaagcgaaaaacaagagtcttgtcaagatttggtgcaaaacttttaccaacaaggtacgtttccaagaatattcccggggcggggagtgaacctttgcatctgaacatgaaactaaatcttgccttcaaggaaggtaaatagaaagtcaggggaaagaaatattgggagtccctgaaaaatcaaaagtgaccagtgaatgcctttagaaaacaagtccttgaatgaatgccaaatgcaggtaaacagtaggacagacagactcccttttgccccatcccagggatacattatttctggtttgttatttccatgcctcttggagaaggcttagctctgcctgccgctctgttctcatttttggagagacttgtggaagtagtccagcacgccctacgggtgttggcagcaagtgtcctctctcttactttccagacttttccagagtattccccctgctcgggcccagagcattcatgccctctgtcaggaacctacccaggctgctttgcacctgggttgtggcttgcccttgcttctggggtgtacatgtattttttttgtggggtgctaaagactggagactagaataaacaaagtagatgtttttaaatgatgaaggctgatttcagttgtcctcagttattctaagatttctaataaaggtgagaaataagtcttcaagagaaaagaactgttctgttggggccatactgcatgcaccatgggtggtgtctgcgcctgttcattcccacccccgccattgcctcccattccccactaaaagccagtgttgtgggcatttgtcatgtttgtcatccagacccagattaacgtcactgttccctcgactgctaactgcacctccccttccctctgttggacggatggcatccaaaactggaccatgaagaatgtgacctacaaggagaacatcgccaaatgtgagtggagctcagtggattggccactatgacaggtgttgtctgggggtgacctatttatccgtgtgaagtcccagtaagtgaaggaaaggacagtaggagtcaccaagcacctgccctacatcaagcagtgagcaacatgctttcacagcagaggaaactatggcttaggaactgaggtgacaggcctgaggtcccacagcaagggcagaactggaacttgaagtccatttcctttgccagctccacaccacctcagaaaagctcaacagattctagaggattccctctacatgctttgttcagattcctttagtcaataactctaggggccaggcatggtgtctcaaggctataatcccagcactttggggaggccgagatgggctggtcacttgaagccaggagtttgagaccagcctggccaacatggtgaaaccctgtttctactaaaaataatacaaaaaaagtaggcatggtggctcaagcctataattccagccaagattgcaccactacactccagcctgggcaacagggagatagtctgtctcaaaataaaataactttagggagacgacaacccgatttgaaggaagatgtgggacccacatagaacagatgtattcactcaattagtccctactgtacagcaggccccatttcagggcactggggctgtagctcttgaacgggcagtgagcttgcatgatgctctgattattaagaagctgtaatgttttttccaacccagccatccttcgttattctaattactccttacatatacttttgtatatctctgcttctctcttctcaccctcccaccacattaattctgagcactatatcttaatactctaggtatgattaccccaaagaatcaagttaacttaccacctcccacattctaggcactatacattcattcatataaccatgttttgctgggattatctgggggatgcagaaggggctttataattagcaatgccccttactttgacttgcccatcgaatccctcaaagcatacttatcattagtaaaaaaaaaaaattagaccatcgacagcatggtctttagagacagaactgggctgagtctacccctgaacagttgtgtgatttttaaagccatcacttcatcttccagcctcatgcgatcccactgattatgacatagtttcagtggtgccccttgctgcgaaggaggctgagaagggctgtcttgatttggggctgccatctgttaaactaacaaccaggaatctgtttgtaggaaagacaggatctgggggaataaataacaatctgtagccgtggtggctccatgccctcctgacaagattctttgtggtctttcaggccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactggtaggtacactgccctcacttgtaggcctcacatgtagtcactgcatggggtgtgggggtcctttagattcccatctagcaatggcctctgcatggagtttctctctcagattggatcagcaccagaagtgaggatgtcattcacctggaaatgttcttggcatcctgggtggggtctagggagcaggcccaagtttccattgcatcttggcaaggtcctgagcaggagttcatatctagagagctgtgagtcaggccttccttcttagcgggtttcctgtatgctcagagctttactggctctgtcaagaccccttagaaaaaggaccccaggtgtctgccctcgcccccacctcccttcactcttgtaaaggaaatgtgatgcataaatacatcagcatctagaggtggccaatgagactgctggctaagaggatttcctgccaagtagggtgtcctggccaatgagagctcgctaagccaatgacatcatcacttcatgaaagctcagtgaaatatagccaagaaaattcgccccccaccccagattgtcttggggaacagagcaactctgggtgcttctgggaaatgcagggcctgatccggtgctagttgggtggaggactcagttggcaggcatgttccaagctgctacagtttcttgatgctctttaaggcagaaatgaaggttgaaggtcaaatgtgggtgctgacaggagaccagggcaggcgaggaagcatgctctcagcactttctggaaggagagtggttacttgggtgggttcactctttctaacctgacctccagggaatctgtgtttttgttttcataacacttacctgtatccttggtttttccatctgaatatgcggagcaaaagacaatggggaatgaaactggattctaaaactctactctgtaatctgagaccatatatgggatgatgtacaacctcacccctaagcccagcccctaccccaggccaccaggccataccttccccggagaggccatgacatctcttccttctgtcttccagatttcccctttccctttgcatggttgactggctacctggccatcctcgtcggggcaggcatgaccttcatcgtacagagcagctctgtgttcacgtcggccttgacccccctgattggtgagttacaccctggcttctccctctggccaccactgccatttcctgtcatcccatggggctgatatgtttgtgttttgtgtttcccccaggaatcggcgtgataaccattgagagggcttatccactcacgctgggctccaacatcggcaccaccaccaccgccatcctggccgccttagccagccctggcaatgcattgaggagttcactccaggtcaggacttggggcacggggacaggggccctgggagtgggaccacccatggtcttgcaaactggtctctaacaagagccaggcttttctctgtactatccaaaatatggaactaatatgtggaggggaagccacgggtaaagttttcaggaccttgatatgagaacaatcaaaactatcagttctgagagaagcagtaagaccctcataactggtggttgtttcagcaaaagtggggtggccccttgatatagatgtggaaaaggtacttaggaagcacagacaccacctcccatctcctcactgcctcctatggggaactttacaattaggagaactccttggcatggaccatctatgttactttgtgcaagacctttgggatttgaatttatttatttatttttattttatttttttgagacagagtctcgcactgtagcccaggctggagtgcagtgatacaatctccactcactgcaacctccacctcccaggttcaagtgattttcctgcctcagcctcccgagcagctgggattacaggcacctgccaccacacctggctgattttttgtatttttagtagagacggggtttccctatgttggccaggctggtcttgaactctggacctcatgatgtgcttgccttggcctcccaaagtgctgggattacaggcgtgagccactgcacccagccggggatttgaattcttatctcaccatttacatactaagtgacctttggcaagtgatctaacctgagcgtcaattccctcatctgaaagatggaggacataacccctatctcattaggattattataaagatctgatgaggcaaagccatctgtgcaacagaaatagaaattcaggcatctaatataaattaaccgcatatgtcatcctaaaattttttagtagatacatttttaaaagtagaaacaggctgattcattcttcaataatgtatttgatctaaaccattatcactttaatatgtcatctgtcaaaaattgagagtctttgaaatctggtgtgtatttcatacttaaagcacatctcagtgtggacatgcggctagtgtattggacagtgctggtccacagcctgggcatggaaattggcaccttgggaaagtgaccaagcgcctggcctctggagccaggctcccaggatgtgaatttccacctcttccatctcccacctgtgggacttgaggagcctccattttctcatgtcaagaaataatggttgccactctgtagagtgttttttgagaattgagataatgcacagttgagtgctcctggccctcccagacacatagtaggtcctcatggaatccaggtaccctctgggctgagccataaggacaaagaaggcctggaaggcccgagactgtgctgcctgtgatgcctgctagcttacctccccctcctcctccctactgccacccgcattgggcaacaggcccctcacctgtccaacctcttgtgttgcagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtgactgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtggtaggcctgcagggcacttttattccaacccctggtcactcagtaatcttttactccaggaaggcacaggatggtacctaaagagaattagagaatgaacctggcgggacggatgtctaatcctgcgcctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattcaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattaagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaatttttttttttttttttttactggttatgggaagggagaaataaaatcatcaaacccaaaa

SEQ ID NO: 315 - DNA, 29 bp, artificial sequence
  CD74-1 forward primer
acgttggatgcaaaagcccactgacgctc

SEQ ID NO: 316 - DNA, 29 bp, artificial sequence
  CD74-2 forward primer
acgttggatgctccagcactccctggtcc

SEQ ID NO: 317 - DNA, 29 bp, artificial sequence
  CD74-3 forward primer
acgttggatgacccacccccatcttgtct

SEQ ID NO: 318 - DNA, 30 bp, artificial sequence
  CD74-4 forward primer
acgttggatgacagggtgcctggggtagaa

SEQ ID NO: 319 - DNA, 29 bp, artificial sequence
  CD74-5 forward primer
acgttggatgacagctgctgccaagagag

SEQ ID NO: 320 - DNA, 30 bp, artificial sequence
  CD74-6 forward primer
acgttggatgtttctatcccggtgctgtct

SEQ ID NO: 321 - DNA, 31 bp, artificial sequence
  CD74-7 forward primer
acgttggatgctcagtttctgcatcagattc

SEQ ID NO: 322 - DNA, 30 bp, artificial sequence
  CD74-8 forward primer
acgttggatgtccaacaaacggtaaacccc

SEQ ID NO: 323 - DNA, 31 bp, artificial sequence
  CD74-9 forward primer
acgttggatgcagaatcgcaagtgcaattcc

SEQ ID NO: 324 - DNA, 30 bp, artificial sequence
  CD74-10 forward primer
acgttggatgctcccgggttcaagcaattc

SEQ ID NO: 325 - DNA, 30 bp, artificial sequence
  CD74-11 forward primer
acgttggatgtagtagagacagggtttcac

SEQ ID NO: 326 - DNA, 30 bp, artificial sequence
  CD74-12 forward primer
acgttggatggtgcctggcccaaaactgta

SEQ ID NO: 327 - DNA, 30 bp, artificial sequence
  CD74-13 forward primer
acgttggatgcagaccttgttggtctaggc

SEQ ID NO: 328 - DNA, 30 bp, artificial sequence
  CD74-14 forward primer
acgttggatgtgtgtgggtctttagctctg

SEQ ID NO: 329 - DNA, 30 bp, artificial sequence
  EZR1 forward primer
acgttggatgggagaagacaaagaaggcag

SEQ ID NO: 330 - DNA, 30 bp, artificial sequence
  EZR2 forward primer
acgttggatgcaggaaggaaaccaagaacg

SEQ ID NO: 331 - DNA, 30 bp, artificial sequence
  EZR3 forward primer
acgttggatggatgctagttgttctaagac

SEQ ID NO: 332 - DNA, 30 bp, artificial sequence
  EZR4 forward primer
acgttggatgacagtgatttgcccacagtc

SEQ ID NO: 333 - DNA, 30 bp, artificial sequence
  EZR5 forward primer
acgttggatgcacagctccagtcaacaacc

SEQ ID NO: 334 - DNA, 30 bp, artificial sequence
  EZR6 forward primer
acgttggatgtgtgttctgagtggagtgtg

SEQ ID NO: 335 - DNA, 30 bp, artificial sequence
  EZR7 forward primer
acgttggatgtggcgttggacgggtttcta

SEQ ID NO: 336 - DNA, 30 bp, artificial sequence
  EZR8 forward primer
acgttggatgaagacatcccctcaacctgt

SEQ ID NO: 337 - DNA, 30 bp, artificial sequence
  SLC34A2-1 forward primer
acgttggatgtattcttagtagcgccttcc

SEQ ID NO: 338 - DNA, 30 bp, artificial sequence
  SLC34A2-2 forward primer
acgttggatgagcctcctggagtgttttag

SEQ ID NO: 339 - DNA, 30 bp, artificial sequence
  SLC34A2-3 forward primer
acgttggatgacaaagggctatgacttggc

SEQ ID NO: 340 - DNA, 30 bp, artificial sequence
  SLC34A2-4 forward primer
acgttggatgcaggaagttgtctgacatac

SEQ ID NO: 341 - DNA, 29 bp, artificial sequence
  SLC34A2-5 forward primer
acgttggatgaaggacagggccccttctc

SEQ ID NO: 342 - DNA, 30 bp, artificial sequence
  SLC34A2-6 forward primer
acgttggatgagtgtgagaacccaggagtg

SEQ ID NO: 343 - DNA, 30 bp, artificial sequence
  SLC34A2-7 forward primer
acgttggatggggccctctatcaaacattc

SEQ ID NO: 344 - DNA, 30 bp, artificial sequence
  SLC34A2-8 forward primer
acgttggatgttcagtctcagatctgggtg

SEQ ID NO: 345 - DNA, 30 bp, artificial sequence
  SLC34A2-9 forward primer
acgttggatgcattcatgggagagcatgag

SEQ ID NO: 346 - DNA, 29 bp, artificial sequence
  SLC34A2-10 forward primer
acgttggatgattggcgtgatctcagctc

SEQ ID NO: 347 - DNA, 30 bp, artificial sequence
  SLC34A2-11 forward primer
acgttggatgcggcttcaagcgattcttct

SEQ ID NO: 348 - DNA, 30 bp, artificial sequence
  SLC34A2-12 forward primer
acgttggatggtctgcaactactgacctca

SEQ ID NO: 349 - DNA, 30 bp, artificial sequence
  SLC34A2-13 forward primer
acgttggatgggctttgctgtctggttatc

SEQ ID NO: 350 - DNA, 30 bp, artificial sequence
  SLC34A2-14 forward primer
acgttggatgtggtctcaggtacactcttg

SEQ ID NO: 351 - DNA, 30 bp, artificial sequence
  SLC34A2-15 forward primer
acgttggatggaattgggtatacaccccag

SEQ ID NO: 352 - DNA, 30 bp, artificial sequence
  SLC34A2-16 forward primer
acgttggatgtttgaagagtgggaggatgc

SEQ ID NO: 353 - DNA, 30 bp, artificial sequence
  SLC34A2-17 forward primer
acgttggatggtgggcagctagtagatttc

SEQ ID NO: 354 - DNA, 30 bp, artificial sequence
  SLC34A2-18 forward primer
acgttggatgagctggccttggatggagat

SEQ ID NO: 355 - DNA, 31 bp, artificial sequence
  ROS1B1 reverse primer
acgttggatgcatatatctctaggattagtg

SEQ ID NO: 356 - DNA, 30 bp, artificial sequence
  ROS1B2 reverse primer
acgttggatggacccagccagtattatttc

SEQ ID NO: 357 - DNA, 30 bp, artificial sequence
  ROS1B3 reverse primer
acgttggatggttatcaccataaaattgtc

SEQ ID NO: 358 - DNA, 29 bp, artificial sequence
  ROS1B4 reverse primer
acgttggatgggtatatctttcagaacac

SEQ ID NO: 359 - DNA, 29 bp, artificial sequence
  ROS1B5 reverse primer
acgttggatgcctttgggtatgtaactag

SEQ ID NO: 360 - DNA, 30 bp, artificial sequence
  ROS1B6 reverse primer
acgttggatggggttgattccaaatgattc

SEQ ID NO: 361 - DNA, 30 bp, artificial sequence
  ROS1B7 reverse primer
acgttggatgccatatccctgcaaaaaaac

SEQ ID NO: 362 - DNA, 30 bp, artificial sequence
  ROS1B8 reverse primer
acgttggatgacttgtaagtgagaacacgc

SEQ ID NO: 363 - DNA, 30 bp, artificial sequence
  ROS1B9 reverse primer
acgttggatggcaaaccatcacctaggtat

SEQ ID NO: 364 - DNA, 30 bp, artificial sequence
  ROS1B10 reverse primer
acgttggatgtacatgtgcaggacgtgaag

SEQ ID NO: 365 - DNA, 31 bp, artificial sequence
  ROS1B11 reverse primer
acgttggatgcaatatatctcaacttgaaac

SEQ ID NO: 366 - DNA, 29 bp, artificial sequence
  ROS1B12 reverse primer
acgttggatggaaatattcagaaatattc

SEQ ID NO: 367 - DNA, 30 bp, artificial sequence
  ROS1B13 reverse primer
acgttggatgggtcaataggtgcagcaaac

SEQ ID NO: 368 - DNA, 30 bp, artificial sequence
  ROS1B14 reverse primer
acgttggatgacacatggatacagagaggg

SEQ ID NO: 369 - DNA, 30 bp, artificial sequence
  ROS1B15 reverse primer
acgttggatgcatggatgaagctggaagtc

SEQ ID NO: 370 - DNA, 30 bp, artificial sequence
  ROS1B16 reverse primer
acgttggatgtggaaccaagccaatccatc

SEQ ID NO: 371 - DNA, 30 bp, artificial sequence
  ROS1B17 reverse primer
acgttggatgtgagtacatacccaaaggag

SEQ ID NO: 372 - DNA, 30 bp, artificial sequence
  ROS1B18 reverse primer
acgttggatgttacactgttggtggtaaag

SEQ ID NO: 373 - DNA, 30 bp, artificial sequence
  ROS1B19 reverse primer
acgttggatgtgagataccatctcacgcga

SEQ ID NO: 374 - DNA, 30 bp, artificial sequence
  ROS1B20 reverse primer
acgttggatgcagacacttctcaaaaaggg

SEQ ID NO: 375 - DNA, 30 bp, artificial sequence
  ROS1B21 reverse primer
acgttggatgctatccatctgacaaagggc

SEQ ID NO: 376 - DNA, 30 bp, artificial sequence
  ROS1B22 reverse primer
acgttggatggagcttctgtacagcaaaag

SEQ ID NO: 377 - DNA, 30 bp, artificial sequence
  ROS1B23 reverse primer
acgttggatgccctagaagaaaacctaggc

SEQ ID NO: 378 - DNA, 30 bp, artificial sequence
  ROS1B24 reverse primer
acgttggatgaaaactgaaactgggcccat

SEQ ID NO: 379 - DNA, 31 bp, artificial sequence
  ROS1B25 reverse primer
acgttggatgccacacatctacaaccatttg

SEQ ID NO: 380 - DNA, 30 bp, artificial sequence
  ROS1B26 reverse primer
acgttggatggctacagtaacacagcatgg

SEQ ID NO: 381 - DNA, 30 bp, artificial sequence
  ROS1B27 reverse primer
acgttggatgcttcatagaattagaaaaag

SEQ ID NO: 382 - DNA, 30 bp, artificial sequence
  ROS1B28 reverse primer
acgttggatgccccatggacaggaataatg

SEQ ID NO: 383 - DNA, 29 bp, artificial sequence
  ROS1B29 reverse primer
acgttggatgcgaatacagctaacaaggg

SEQ ID NO: 384 - DNA, 30 bp, artificial sequence
  ROS1B30 reverse primer
acgttggatgcctttacaccaacaataggc

SEQ ID NO: 385 - DNA, 30 bp, artificial sequence
  ROS1B31 reverse primer
acgttggatgcatctcagcccaaaaacttc

SEQ ID NO: 386 - DNA, 30 bp, artificial sequence
  ROS1B32 reverse primer
acgttggatggggcaatcaggcaagaggaa

SEQ ID NO: 387 - DNA, 30 bp, artificial sequence
  ROS1B33 reverse primer
acgttggatggaatgagcaaaacctggaag

SEQ ID NO: 388 - DNA, 29 bp, artificial sequence
  ROS1B34 reverse primer
acgttggatgaattcaacatcaacatccc

SEQ ID NO: 389 - DNA, 30 bp, artificial sequence
  ROS1B35 reverse primer
acgttggatgcaataaatgtaatccatcac

SEQ ID NO: 390 - DNA, 30 bp, artificial sequence
  ROS1B36 reverse primer
acgttggatgactggcaaactgaatccagc

SEQ ID NO: 391 - DNA, 30 bp, artificial sequence
  ROS1B37 reverse primer
acgttggatgactcattttatgaagccagc

SEQ ID NO: 392 - DNA, 30 bp, artificial sequence
  ROS1B38 reverse primer
acgttggatgccagatggattcacagctga

SEQ ID NO: 393 - DNA, 30 bp, artificial sequence
  ROS1B39 reverse primer
acgttggatggaagaagttgaatccctgac

SEQ ID NO: 394 - DNA, 31 bp, artificial sequence
  ROS1B40 reverse primer
acgttggatggaccccacagaaatacaaaat

SEQ ID NO: 395 - DNA, 29 bp, artificial sequence
  ROS1B41 reverse primer
acgttggatgaatataccactagctagag

SEQ ID NO: 396 - DNA, 29 bp, artificial sequence
  ROS1B42 reverse primer
acgttggatggagaagaactgaaggagac

SEQ ID NO: 397 - DNA, 30 bp, artificial sequence
  ROS1B43 reverse primer
acgttggatggccagaaagatctcaaatcg

SEQ ID NO: 398 - DNA, 31 bp, artificial sequence
  ROS1B44 reverse primer
acgttggatgcaaatgagaacagagacaatg

SEQ ID NO: 399 - DNA, 30 bp, artificial sequence
  ROS1B45 reverse primer
acgttggatgcaaaaccacacaatttcctg

SEQ ID NO: 400 - DNA, 30 bp, artificial sequence
  ROS1B46 reverse primer
acgttggatggaagtaaaacactcctcagc

SEQ ID NO: 401 - DNA, 30 bp, artificial sequence
  ROS1B47 reverse primer
acgttggatgtcaagtggacctagtagatg

SEQ ID NO: 402 - DNA, 30 bp, artificial sequence
  ROS1B48 reverse primer
acgttggatgagactgccacgcaatagtag

SEQ ID NO: 403 - DNA, 31 bp, artificial sequence
  ROS1B49 reverse primer
acgttggatgcaagaagagttaactattctg

SEQ ID NO: 404 - DNA, 30 bp, artificial sequence
  ROS1B50 reverse primer
acgttggatgaaaagagggttgcaatccta

SEQ ID NO: 405 - DNA, 31 bp, artificial sequence
  ROS1B51 reverse primer
acgttggatgcaggagatctatcttacatgc

SEQ ID NO: 406 - DNA, 30 bp, artificial sequence
  ROS1B52 reverse primer
acgttggatgctcacataacaatacctacc

SEQ ID NO: 407 - DNA, 31 bp, artificial sequence
  ROS1B53 reverse primer
acgttggatgcacaccaaactataaagatca

SEQ ID NO: 408 - DNA, 30 bp, artificial sequence
  ROS1B54 reverse primer
acgttggatgtgctgagggattttgttacc

SEQ ID NO: 409 - DNA, 30 bp, artificial sequence
  ROS1B55 reverse primer
acgttggatggggccaacatcaacattctt

SEQ ID NO: 410 - DNA, 30 bp, artificial sequence
  ROS1B56 reverse primer
acgttggatgagaaaggccaggttacctac

SEQ ID NO: 411 - DNA, 30 bp, artificial sequence
  ROS1B57 reverse primer
acgttggatgattcggcaaacacagagaac

SEQ ID NO: 412 - DNA, 30 bp, artificial sequence
  ROS1B58 reverse primer
acgttggatgggaaaatggaaacacgtggg

SEQ ID NO: 413 - DNA, 29 bp, artificial sequence
  ROS1B59 reverse primer
acgttggatgcatgctgacaagaagagag

SEQ ID NO: 414 - DNA, 30 bp, artificial sequence
  ROS1B60 reverse primer
acgttggatggtgaagcatacacaagtgtc

SEQ ID NO: 415 - DNA, 30 bp, artificial sequence
  ROS1B61 reverse primer
acgttggatgccttgataaaaagttggagg

SEQ ID NO: 416 - DNA, 30 bp, artificial sequence
  ROS1B62 reverse primer
acgttggatgggaggatcagatggatgaac

SEQ ID NO: 417 - DNA, 30 bp, artificial sequence
  ROS1B63 reverse primer
acgttggatgcgaaggtgagaaagaaccaa

SEQ ID NO: 418 - DNA, 29 bp, artificial sequence
  ROS1B64 reverse primer
acgttggatggcatcatcatcaacaacaa

SEQ ID NO: 419 - DNA, 30 bp, artificial sequence
  ROS1B65 reverse primer
acgttggatgaggcctaaagtgaaccccag

SEQ ID NO: 420 - DNA, 30 bp, artificial sequence
  ROS1B66 reverse primer
acgttggatgttggtgccccttgaagtcag

SEQ ID NO: 421 - DNA, 30 bp, artificial sequence
  ROS1B67 reverse primer
acgttggatggcttcgttaaatgggtcctc

SEQ ID NO: 422 - DNA, 30 bp, artificial sequence
  ROS1B68 reverse primer
acgttggatgggtagttctgaggaatctgg

SEQ ID NO: 423 - DNA, 30 bp, artificial sequence
  ROS1B69 reverse primer
acgttggatgaatcttcagtaactgcagcc

SEQ ID NO: 424 - DNA, 30 bp, artificial sequence
  ROS1B70 reverse primer
acgttggatgaacacaccagctgtggtagt

SEQ ID NO: 425 - DNA, 30 bp, artificial sequence
  ROS1B71 reverse primer
acgttggatggggagaaatgcagcatccat

SEQ ID NO: 426 - DNA, 30 bp, artificial sequence
  ROS1B72 reverse primer
acgttggatgtgctgtctaagccctttgag

SEQ ID NO: 427 - DNA, 30 bp, artificial sequence
  ROS1B73 reverse primer
acgttggatgaccgaggcctagcatcccaa

SEQ ID NO: 428 - DNA, 30 bp, artificial sequence
  ROS1B74 reverse primer
acgttggatgagcggcgagcgagcaggcta

SEQ ID NO: 429 - DNA, 30 bp, artificial sequence
  ROS1B75 reverse primer
acgttggatgaattgactagaaggctggcg

SEQ ID NO: 430 - DNA, 30 bp, artificial sequence
  ROS1B76 reverse primer
acgttggatgccgttcagaggttcctattg

SEQ ID NO: 431 - DNA, 30 bp, artificial sequence
  ROS1B77 reverse primer
acgttggatgctacagaatatattaagagg

SEQ ID NO: 432 - DNA, 30 bp, artificial sequence
  ROS1B78 reverse primer
acgttggatggaatgcctggtttatttggg

SEQ ID NO: 433 - DNA, 29 bp, artificial sequence
  ROS1A1 reverse primer
acgttggatgagtcaccattatctattgc

SEQ ID NO: 434 - DNA, 31 bp, artificial sequence
  ROS1A2 reverse primer
acgttggatggggagaaaaatgacatgatga

SEQ ID NO: 435 - DNA, 30 bp, artificial sequence
  ROS1A3 reverse primer
acgttggatgagaacagattgtgaacagcc

SEQ ID NO: 436 - DNA, 30 bp, artificial sequence
  ROS1A4 reverse primer
acgttggatgaaacaaaggtcttaggcctg

SEQ ID NO: 437 - DNA, 30 bp, artificial sequence
  ROS1A5 reverse primer
acgttggatgcatatggcactgagatttcc

SEQ ID NO: 438 - DNA, 30 bp, artificial sequence
  ROS1A6 reverse primer
acgttggatggaaagccaaggtggaaagag

SEQ ID NO: 439 - DNA, 30 bp, artificial sequence
  ROS1A7 reverse primer
acgttggatgtgtgggtatttcagagaggg

SEQ ID NO: 440 - DNA, 30 bp, artificial sequence
  ROS1A8 reverse primer
acgttggatgagataaaccacaattggagg

SEQ ID NO: 441 - DNA, 30 bp, artificial sequence
  ROS1A9 reverse primer
acgttggatgttctaggctgaggcaaacac

SEQ ID NO: 442 - DNA, 30 bp, artificial sequence
  ROS1A10 reverse primer
acgttggatgcaggtaagcattatgatgag

SEQ ID NO: 443 - DNA, 30 bp, artificial sequence
  ROS1A11 reverse primer
acgttggatgctaactagataactaactat

SEQ ID NO: 444 - DNA, 30 bp, artificial sequence
  ROS1A12 reverse primer
acgttggatgagagatcacatgtagcctgc

SEQ ID NO: 445 - DNA, 30 bp, artificial sequence
  ROS1A13 reverse primer
acgttggatgtgtaccccctattagctatg

SEQ ID NO: 446 - DNA, 30 bp, artificial sequence
  ROS1A14 reverse primer
acgttggatggtgtagaggaaacaaacacg

SEQ ID NO: 447 - DNA, 29 bp, artificial sequence
  ROS1A15 reverse primer
acgttggatgtggatactaaatagttggc

SEQ ID NO: 448 - DNA, 30 bp, artificial sequence
  ROS1A16 reverse primer
acgttggatgccactggaatatatccactc

SEQ ID NO: 449 - DNA, 30 bp, artificial sequence
  ROS1A17 reverse primer
acgttggatggttgttagaccgttggtagc

SEQ ID NO: 450 - DNA, 30 bp, artificial sequence
  ROS1A18 reverse primer
acgttggatgcatagataaaagctaagttg

SEQ ID NO: 451 - DNA, 30 bp, artificial sequence
  ROS1A19 reverse primer
acgttggatggtcagtgggattgtaacaac

SEQ ID NO: 452 - DNA, 27 bp, artificial sequence
  ROS1A1 Probe
aatgttaagaatgtactgatatttatt

SEQ ID NO: 453 - DNA, 22 bp, artificial sequence
  ROS1A2 Probe
tgttttagaaagatcacatcac

SEQ ID NO: 454 - DNA, 18 bp, artificial sequence
  ROS1A3 Probe
tggaagcctaattaggag

SEQ ID NO: 455 - DNA, 21 bp, artificial sequence
  ROS1A4 Probe
gcctgttatgtataatgtagg

SEQ ID NO: 456 - DNA, 17 bp, artificial sequence
  ROS1A5 Probe
tttcctgcctatgtgat

SEQ ID NO: 457 - DNA, 18 bp, artificial sequence
  ROS1A6 Probe
tggaaagaggaagatgag

SEQ ID NO: 458 - DNA, 20 bp, artificial sequence
  ROS1A7 Probe
ttaagtaatccagcctgtgc

SEQ ID NO: 459 - DNA, 21 bp, artificial sequence
  ROS1A8 Probe
ttggaggataaattacagaag

SEQ ID NO: 460 - DNA, 16 bp, artificial sequence
  ROS1A9 Probe
gaaacacagggccaaa

SEQ ID NO: 461 - DNA, 19 bp, artificial sequence
  ROS1A10 Probe
tcttgaaggatgagaagaa

SEQ ID NO: 462 - DNA, 23 bp, artificial sequence
  ROS1A11 Probe
taaacaagaatcatgtaagtttt

SEQ ID NO: 463 - DNA, 22 bp, artificial sequence
  ROS1A12 Probe
ttgcctgcaaagtctaacatat

SEQ ID NO: 464 - DNA, 25 bp, artificial sequence
  ROS1A13 Probe
gttttacctttgtaaagtgttattt

SEQ ID NO: 465 - DNA, 19 bp, artificial sequence
  ROS1A14 Probe
aaaccaaacacgtaggcca

SEQ ID NO: 466 - DNA, 27 bp, artificial sequence
  ROS1A15 Probe
gttggcattattattttgtataatatc

SEQ ID NO: 467 - DNA, 22 bp, artificial sequence
  ROS1A16 Probe
gccactcaatcttctactttaa

SEQ ID NO: 468 - DNA, 18 bp, artificial sequence
  ROS1A17 Probe
tgaaagcatccatacaga

SEQ ID NO: 469 - DNA, 15 bp, artificial sequence
  ROS1A18 Probe
gctaagttgccccag

SEQ ID NO: 470 - DNA, 26 bp, artificial sequence
  ROS1A19 Probe
aactataatagtaagtatgaaacttg

SEQ ID NO: 471 - DNA, 15 bp, artificial sequence
  SLC34A2-1 Probe
tccagctggttggag

SEQ ID NO: 472 - DNA, 18 bp, artificial sequence
  SLC34A2-2 Probe
gagtgttttaggactgga

SEQ ID NO: 473 - DNA, 17 bp, artificial sequence
  SLC34A2-3 Probe
ccttaggccaggagctg

SEQ ID NO: 474 - DNA, 20 bp, artificial sequence
  SLC34A2-4 Probe
ttagctgaggaattcctata

SEQ ID NO: 475 - DNA, 19 bp, artificial sequence
  SLC34A2-5 Probe
tctccccttctctgggctg

SEQ ID NO: 476 - DNA, 17 bp, artificial sequence
  SLC34A2-6 Probe
caccatgtgcttggttc

SEQ ID NO: 477 - DNA, 17 bp, artificial sequence
  SLC34A2-7 Probe
acattctttcccagagc

SEQ ID NO: 478 - DNA, 17 bp, artificial sequence
  SLC34A2-8 Probe
cctgggtgacacaaagg

SEQ ID NO: 479 - DNA, 15 bp, artificial sequence
  SLC34A2-9 Probe
ggggcaaacacttcc

SEQ ID NO: 480 - DNA, 15 bp, artificial sequence
  SLC34A2-10 Probe
cagctcaccgcgacc

SEQ ID NO: 481 - DNA, 18 bp, artificial sequence
  SLC34A2-11 Probe
ttagacctcagttgttcc

SEQ ID NO: 482 - DNA, 20 bp, artificial sequence
  SLC34A2-12 Probe
ggttatctcagacaaatcac

SEQ ID NO: 483 - DNA, 19 bp, artificial sequence
  SLC34A2-13 Probe
ctctcccagcattcaatta

SEQ ID NO: 484 - DNA, 17 bp, artificial sequence
  SLC34A2-14 Probe
taaggaggctcattgga

SEQ ID NO: 485 - DNA, 15 bp, artificial sequence
  SLC34A2-15 Probe
atgcagggtgaagga

SEQ ID NO: 486 - DNA, 21 bp, artificial sequence
  SLC34A2-16 Probe
gtgtagatttcctgccttatc

SEQ ID NO: 487 - DNA, 20 bp, artificial sequence
  SLC34A2-17 Probe
tggagattctgtttactcag

SEQ ID NO: 488 - DNA, 17 bp, artificial sequence
  SLC34A2-5 shifted Probe
atcgtgtgcccatgcag

SEQ ID NO: 489 - DNA, 16 bp, artificial sequence
  SLC34A2-6 shifted Probe
actgggtgcaggcatt

SEQ ID NO: 490 - DNA, 17 bp, artificial sequence
  SLC34A2-3 shifted Probe
tgtccacaaaccccagg

SEQ ID NO: 491 - DNA, 19 bp, artificial sequence
  SLC34A2-7 shifted Probe
tgtgattagcagagtaaga

SEQ ID NO: 492 - DNA, 15 bp, artificial sequence
  SLC34A2-4 shifted Probe
atgggcccttgctgg

SEQ ID NO: 493 - DNA, 15 bp, artificial sequence
  SLC34A2-8 shifted Probe
agttggggaggtggg

SEQ ID NO: 494 - DNA, 211 bp, Homo sapiens
  misc_feature: SLC34A2-ROS1 rearrangement
catgaaccagccctgagactcacagcctgtgattagaaaactctgtgtttcagtttttttcttatcacttatttcactactcctagagatatatatgaaattgttctttaaaagcagtacattattatttctagaacttgaatgaagaaattcagaaaatataggagaccttgcaggcagtaatgaaataatactggctgggtccatccaa

The invention claimed is:

1. An in vitro method for detecting chromosomal rearrangements between at least two specific chromosomal regions in a biological sample of a human subject, wherein said rearrangement is a ELM4-ALK, ROS1-CD74, ROS1-EZR, or ROS1-SLC34A2 chromosomal rearrangement, said method comprising the steps of:
   a) isolating deoxyribonucleic acid (DNA) molecules comprising said specific chromosomal regions from said biological sample, wherein said DNA molecules have an average length of X base pairs;
   b) amplifying the DNA molecules of step a) by a multiplex polymerase chain reaction assay,
   said assay comprising at least two sets of primers, wherein each set of primers is capable of hybridizing with a specific chromosomal region, and
   each set of primer comprises a plurality of primers,
   said primers being capable of hybridizing to a nucleic acid strand of one of the said specific chromosomal regions at sites regularly spaced of less than X/2 base pairs; and
   c) hybridizing the product of the amplification of step b) with at least one set of nucleic probes,
wherein said set of nucleic acid probes comprises a plurality of nucleic acid probes,
   said probes being capable of hybridizing to a nucleic acid strand of one of the said specific chromosomal regions at sites regularly spaced of less than X/2 base pairs; and
   the 5' end of said probe being capable of hybridizing within 0 to 30 bases from the 3' end of a primer capable of hybridizing to the same specific chromosomal region; and
wherein the successful hybridization of at least one probe of said set of nucleic probes to product of the amplification of step b) indicates the presence of a chromosomal rearrangement.

2. The method of claim 1, wherein X is inferior or equal to 600.

3. The method of claim 1, wherein said biological sample is a formalin-fixed, paraffin-embedded (FFPE) tissue sample or a blood-derived sample.

4. The method of claim 1, wherein said biological sample is a tumor tissue.

5. The method of claim 4, wherein said tumor is selected from the group consisting of carcinoma, including that of the bladder, breast, colon, kidney, liver, lung, ovary, pancreas, stomach, cervix, thyroid and skin; including squamous cell carcinoma; tumors of mesenchymal origin, including fibrosarcoma and rhabdomyoscarcoma; other tumors, including melanoma, seminoma, tetratocarcinoma, neuroblastoma and glioma; tumors of the central and peripheral nervous system, including astrocytoma, neuroblastoma, glioma, and schwannomas; tumors of mesenchymal origin, including fibrosarcoma, rhabdomyoscarama, and osteosarcoma; and other tumors, including melanoma, xeroderma pigmentosum, keratoactanthoma, seminoma, thyroid follicular cancer and teratocarcinoma.

6. The method of claim 5, wherein the said tumor is a lung tumor.

7. The method of claim 1, further comprising a step of detecting the hybridization of step c).

8. The method of claim 7, wherein said detection is performed by mass spectrometry.

9. The method of claim 1, said method further comprising a step of sequencing the product of amplification of step b).

10. The method of claim 1, said method being for detecting chromosomal rearrangements between two specific chromosomal regions.

11. The method of claim 1, wherein said specific chromosomal regions comprise at least the anaplastic lymphoma kinase gene (ALK) of sequence SEQ ID No.1.

12. The method of claim 11, wherein said specific chromosomal regions further comprise the echinoderm microtubule-associated protein-like 4 gene (EML4) of SEQ ID No.4.

13. The method of claim 1, wherein said specific chromosomal regions further comprise the ROS1 gene of sequence SEQ ID No.5.

14. An in vitro method for diagnosing cancer, wherein the method comprises detecting chromosomal rearrangements between at least two specific chromosomal regions in a biological sample of said human subject with the method of claim 1.

15. The method of claim 14, wherein said cancer is non-small cell lung cancer.

16. The method of claim 14, wherein said specific chromosomal regions comprise at least the ROS1 gene of sequence SEQ ID No.5 and at least one of the CD74 gene (CD74) of sequence SEQ ID No.312, the EZR gene (EZR) of sequence SEQ ID No.313, and the SLC34A2 gene (SLC34A2) of sequence SEQ ID No.314.

17. The method of claim 14, wherein said method comprises:
   a) detecting chromosomal rearrangements between at least two specific chromosomal regions in a biological sample of said human subject;
   b) diagnosing cancer in said human subject if a chromosomal rearrangement has been detected in step a).

18. A method for the treatment of cancer in a human subject in need thereof, comprising diagnosing cancer in a human subject with the method of claim 14 and administering an effective amount of anti-cancer therapy to said subject.

19. The method of claim 18 comprising diagnosing non-small cell lung cancers that comprise a chromosomal rearrangement involving the gene ALK or the gene ROS1 in a human subject and administering an effective amount of ALK inhibitors to said subject.

* * * * *